United States Patent 8,586,006 (ORGAN-SPECIFIC PROTEINS AND METHODS OF THEIR USE) - sequence listing, part 16

SEQ ID NO: 28595 - protein, 3354 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTQGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 28596 - protein, 530 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 28597 - protein, 212 aa, Homo sapiens
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLVAACLLLYLSDTISPEQAIDSLRDLRGSGAIQTIKQYNYLHEFRDKLAAHLSSRDSQSRSVSR

SEQ ID NO: 28598 - protein, 252 aa, Homo sapiens
MDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVPDVSLLFLRIISACANGKIRIYNFLHGNCMKVIKANGRGDPVLSFFIQGNRISVCHISTFAKRINVGWNGIEPSATAQGGNASLTECAHVRLHIAGHLPASRLPVAAVQPMTGGMAPTTAPTHVLAMLILFSGV

SEQ ID NO: 28599 - protein, 151 aa, Homo sapiens
MDARRMKKEGLTENTGLPRKLLEKHDPWPAYVTYTSQTVKRLIEKSKTRELECMRALEERPWASRQNKPSSVIQPKRRKSSKSSGKAVFRDTLSESTLSMWGAYSVLAMAPTMIPEPTHLHADSRDCPTENYNKIIFARKPMMRMLPTVRY

SEQ ID NO: 28600 - protein, 211 aa, Homo sapiens
MRTLEATSGLDPHSGPGEWIVSPGEVSTAPPVGVTETDTGPAPREGVGLGPVRRTPSRMLTQNGVEVGAALDPRAPACLLGSPVTQAALTLSLCNPKLLLPSPSRGPFKRGWCFSLAPGTLPACRPRRKPRLRFVRGPGSIGGVVRASLGEDVVASVCWWRRWQASAGNPENTAEVECGDVCDTGDRATVDEEGYIWFLGRSHDTINASGW

SEQ ID NO: 28601 - protein, 211 aa, Homo sapiens; identical to SEQ ID NO: 28600

SEQ ID NO: 28602 - protein, 2701 aa, Homo sapiens
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQEMQLIHEISNLKNLVKHAEVYNQDLENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSTLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKEVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKIQELQKKELQLLRVKEDVNMSHKKINEMEQLKKQFEAQNLSMQSVRMDNFQLTKKLHESLEEIRIVAKERDELRRIKESLKMERDQFIATLREMIARDRQNHQVKPEKRLLSDGQQHLTESLREKCSRIKELLKRYSEMDDHYECLNRLSLDLEKEIEFQKELSMRVKANLSLPYLQTKHIEKLFTANQRCSMEFHRIMKKLKYVLSYVTKIKEEQHESINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 28603 - protein, 1140 aa, Homo sapiens
MTTAVERKYINIRKRLDQLGYRQTLTVECLPLVEKLFSDLVHTTESLRQSKLSAVKAEKESANFDFVLEPYKLENARLSRENNELYLELMKLREHSDQHVKELKTSLKKCARETADLKFLNNQYAHKLKLLEKESKAKNERIQQLQEKNLHAVVQTPGGKKRSIAFRRQRMQIDEPVPPSEVSSYPVPQPDDPYIADLLQVADNRIQELQQEVHQLQEKLAMMESGVRDYSKQIELREREIERLSVALDGGRSPDVLSLESRNKTNEKLIAHLNIQVDFLQQANKDLEKRIRELMETKETVTSEVVNLSNKNEKLCQELTEIDQLAQQLERHKEEVLETADKELGEAKKEIKRKLSEMQDLEETMAKLQLELNLCQKEKERLSDELLVKSDLETVVHQLEQEKQRLSKKVESFAVTERQLTLEVERMRLEHGIKRRDRSPSRLDTFLKGIEEERDYYKKELERLQHIIQRRSCSTSYSAREKSSIFRTPEKGDYNSEIHQITRERDELQRMLERFEKYMEDIQSNVKLLTAERDKLSVLYNEAQEELSALRKESTQTTAPHNIVSLMEKEKELALSDLRRIMAEKEALREKLEHIEEVSLFGKSELEKTIEHLTCVNHQLESEKYELKSKVLIMKETIESLENKLKVQAQKFSHVAGDSSHQKTEVNSLRIVNEQLQRSVDDYQHRLSIKRGELESAQAQIKILEEKIDELNLKMTSQDEEAHVMKKTIGVIDKEKDFLQETVDEKTEKIANLQENLANKEKAVAQMKIMISECESSVNQLKETLVNRDREINSLRRQLDAAHKELDEVGRSREIAFKENRRLQDDLATMARENQEISLELEAAVQEKEEMKSRVHKYITEVSRWESLMAAKEKENQDLLDRFQMLHNRAEDWEVKAHQAEGESSSVRLELLSIDTERRHLRERVELLEKEIQEHINAHHAYESQISSMAKAMSRLEEELRHQEDEKATVLNDLSSLRELCIKLDSGKDIMTQQLNSKNLEFERVVVELENVKSESDLLKKQLSNERHTVKNLESLLATNRDKEFHSHLTSHEKDTEIQLLKEKLTLSESKLTSQSRENTMLRAKVAQLQTDYDALKRQISTERYERERAIQEMRRHGLATPPLSSTLRSPSHSPEHRNV

SEQ ID NO: 28604 - protein, 597 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVSHFQKLFDVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 28605 - protein, 659 aa, Homo sapiens
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 28606 - protein, 557 aa, Homo sapiens
MDSTVPSALELPQRLALNPRESPRSPEEEEPHLLSSLAAVQTLASVIRPCYGPHGRQKFLVTMKGETVCTGCATAILRALELEHPAAWLLREAGQTQAENSGDGTAFVVLLTEALLEQAEQLLKAGLPRPQLREAYATATAEVLATLPSLAIQSLGPLEDPSWALHSVMNTHTLSPMDHLTKLVAHACWAIKELDGSFKPERVGVCALPGGTLEDSCLLPGLAISGKLCGQMATVLSGARVALFACPFGPAHPNAPATARLSSPADLAQFSKGSDQLLEKQVGQLAAAGINVAVVLGEVDEETLTLADKYGIVVIQARSWMEIIYLSEVLDTPLLPRLLPPQRPGKCQRVYRQELGDGLAVVFEWECTGTPALTVVLRGATTQGLRSAEQAVYHGIDAYFQLCQDPRLIPGAGATEMALAKMLSDKGSRLEGPSGPAFLAFAWALKYLPKTLAENAGLAVSDVMAEMSGVHQGGNLLMGVGTEGIINVAQEGVWDTLIVKAQGFRAVAEVVLQLVTVDEIVVAKKSPTHQEIWNPDSKKTKKHPPPVETKKILGLNN

SEQ ID NO: 28607 - protein, 172 aa, Homo sapiens
MASGFKKPSAASTGQKRKVAPKPELTEDQKQEVREAFDLFDVDGSGTIDAKELKVAMRALGFEPRKEEMKKMISEVDREGTGKISFNDFLAVMTQKMSEKDTKEEILKAFRLFDDDETGKISFKNLKRVANELGENLTDEELQEMIDEADRDGDGEVNEEEFLRIMKKTSLY

SEQ ID NO: 28608 - protein, 2302 aa, Homo sapiens
MKGESKRITLVLQQPQSGGPQGHRHVVLGSLPGKIVLQGNQLAALTQAKNAQGQPAKVVTIQLQVQQPQQKIQIVPQPPSSQPQPQQPPSTQPVTLSSVQQAQIMGPGQSPGQRLSVPVKVVLQPQAGSSQGASSGLSVVKVLSASEVAALSSPASSAPHSGGKTGMEENRRLEHQKKQEKANRIVAEAIARARARGEQNIPRVLNEDELPSVRPEEEGEKKRRKKSAGERLKEEKPKKSKTSGASKTKGKSKLNTITPVVGKKRKRNTSSDNSDVEVMPAQSPREDEESSIQKRRSNRQVKRKKYTEDLDIKIADDEEEEEVDVTGPIKPEPILPEPVQEPDGETLPSMQFFVENPSEEDAAIVDKVLSMRIVKKELPSGQYTEAEEFFVKYKNYSYLHCEWATISQLEKDKRIHQKLKRFKTKMAQMRHFFHEDEEPFNPDYVEVDRILDESHSIDKDNGEPVIYYLVKWCSLPYEDSTWELKEDVDEGKIREFKRIQSRHPELKRVNRPQASAWKKLELSHEYKNRNQLREYQLEGVNWLLFNWYNRQNCILADEMGLGKTIQSIAFLQEVYNVGIHGPFLVIAPLSTITNWEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKNFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAQSSPHVDSSTMLHHHHHHPHPHHHHHHHPGLRAPGYPSSPVTTASGTTLRLPPLQPEEDDDEDEEDDDDLSQGYDSSERDFSLIDDPMMPANSDSSEDADD

SEQ ID NO: 28609 - protein, 185 aa, Homo sapiens
MGQCLRYQMHWEDLEEYQALTFLTRNEILCIHDTFLKLCPPGKYYKEATLTMDQVSSLPALRVNPFRDRICRVFSHKGMFSFEDVLGMASVFSEQACPSLKIEYAFRIYDFNENGFIDEEDLQRIILRLLNSDDMSEDLLMDLTNHVLSESDLDNDNMLSFSEFEHAMAKSPDFMNSFRIHFWGC

SEQ ID NO: 28610 - protein, 244 aa, Homo sapiens
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCLVNSAGCHLVAGLLFFLAGTVSLSPSIWVIFYNIHLNKKFEPVFSFDYAVYVTIASAGGLFMTSLILFIWYCTCKSLPSPFWQPLYSHPPSMHTYSQPYSARSRLSAIEIDIPVVSHTT

SEQ ID NO: 28611 - protein, 232 aa, Homo sapiens
MSEEVNYATLTFQDSAGARNNRDGNNLRKRGHPAPSPIWRHAALGLVTLCLMLLIGLVTLGMMFLQISNDINSDSEKLSQLQKTIQQQQDNLSQQLGNSNNLSMEEEFLKSQISSLLKRQEQMAIKLCQELIIHTSDHRCNPCPKMWQWYQNSCYYFTTNEEKTWANSRKDCIDKNSTLVKIDSLEEKDFLMSQPLLMFSFFWLGLSWDSSGRSWFWEDGSVPSPSLYVSNY

SEQ ID NO: 28612 - protein, 610 aa, Homo sapiens
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 28613 - protein, 707 aa, Homo sapiens
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSRLLSEGADVNAKHRLGWTALMVAAINRNNSVVQVLLAAGADPNLGDDFSSVYKTAKEQGIHSLEDGGQDGASRHITNQWTSALEFRRWLGLPAGVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 28614 - protein, 642 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKVTSPSQHVPCLILLLLSALLFSLCDSI

SEQ ID NO: 28615 - protein, 654 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKGFRGVKGEKGEPGQPGLDGLDAPCQLGPDGLPMPGCWQK

SEQ ID NO: 28616 - protein, 195 aa, Homo sapiens
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 28617 - protein, 581 aa, Homo sapiens
MTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 28618 - protein, 610 aa, Homo sapiens
MQRDFRWLWVYEIGYAADNSRTLNVDSTAMTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 28619 - protein, 88 aa, Homo sapiens
MLDVEAQEPPKGKWSTPPFDPRFPSQNQIRNCYQNFLDYHRCLKTRTRRGKSTQPCEYYFRVYHSLCPISWVESWNEQIKNGIFAGKI

SEQ ID NO: 28620 - protein, 301 aa, Homo sapiens
MSSPTKEGSDTAGNAHKNSENEPPNDCSTDIESPSADPNMIYQVETNPINREPGTATSQEDVVPQAAENSELETEIQKDQREEDLKEELLLLQTPIPRKLVSHKPLNDRSRSHSGKVEMKANNFPINHKTRFRLSTSWRVPFINSHEIRSMILHLLCDRYFSQAAGCQNTMWVKRKYIACLYHPNSFTHHERAITFRRPSRVHYYRPLTERMTSGKFCKSTDTKGKCRFRAIVRSVLFVSQIQIESIFNIKGFVDILTYIHTMNVMITNTNNGWKYFCPICGRLFNTYSELRQHSCSSSGN

SEQ ID NO: 28621 - protein, 756 aa, Homo sapiens
MSRPGTATPALALVLLAVTLAGVGAQGAALEDPDYYGQEIWSREPYYARPEPELETFSPPLPAGPGEEWERRPQEPRPPKRATKPKKAPKREKSAPEPPPPGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLWEAEDRQNVPRKVPNHYIAIPEWFLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGRKRRQRG

SEQ ID NO: 28622 - protein, 243 aa, Homo sapiens
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAGNNMNRKNTPYQQGTPCAGCPDDCDKGLCTNSCQYQDLLSNCDSLKNTAGCEHELLKEKCKATCLCENKIY

SEQ ID NO: 28623 - protein, 174 aa, Homo sapiens
MGKITFYEDRAFQGRSYETTTDCPNLQPYFSRCNSIRVESGCWMLYERPNYQGQQYLLRRGEYPDYQQWMGLSDSIRSCCLIPQTVSHRLRLYEREDHKGLMMELSEDCPSIQDRFHLSEIRSLHVLEGCWVLYELPNYRGRQYLLRPQEYRRCQDWGAMDAKAGSLRRVVDLY

SEQ ID NO: 28624 - protein, 147 aa, Homo sapiens
MLGLPWKGGLSWALLLLLLGSQILLIYAWHFHEQRDCDEHNVMARYLPATVEFAVHTFNQQSKDYYAYRLGHILNSWKEQVESKTVFSMELLLGRTRCGKFEDDIDNCHFQESTELNNTFTCFFTISTRPWMTQFSLLNKTCLEGFH

SEQ ID NO: 28625 - protein, 189 aa, Homo sapiens
MTDKTEKVAVDPETVFKRPRECDSPSYQKRQRMALLARKQGAGDSLIAGSAMSKAKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 28626 - protein, 189 aa, Homo sapiens
MTDKTEKVAVDPETVFKRPRECDSPSYQKRQRMALLARKQGAGDSLIAGSAMSKAKKLMTGHAIPPSQLDSQIDDFTGFSKDRMMQKPGSNAPVGGNVTSSFSGDDLECRETASSPKSQQEINADIKRKLVKELRCVGQKYEKIFEMLEGVQGPTAVRKRFFESIIKEAARCMRRDFVKHLKKKLKRMI

SEQ ID NO: 28627 - protein, 189 aa, Homo sapiens; identical to SEQ ID NO: 28626

SEQ ID NO: 28628 - protein, 309 aa, Homo sapiens
MAVNQSHTENRRGALIPNGESLLKRSPNVELSFPQRSEGSNVFSGRKTGTLFLTSYRVIFITSCSISDPMLSFMMPFDLMTNLTVEQPVFAANFIKGTIQAAPYGGWEGQATFKLVFRNGGAIEFAQLMVKAASAAARGFPLRTLNDWFSSMGIYVITGEGNMCTPQMPCSVIVYGAPPAGYGAPPPGYGAPPAGYGAQPVGNEGPPVGYRASPVRYGAPPLGYGAPPAGYGAPPLGYGAPPLGYGTPPLGYGAPPLGYGAPPAGNEGPPAGYRASPAGSGARPHESTAAQAPENEASLPSASSSQVHS

SEQ ID NO: 28629 - protein, 210 aa, Homo sapiens
MQAEGQGTGGSTGDADGPGGPGIPDGPGGNAGGPGEAGATGGRGPRGAGAARASGPRGGAPRGPHGGAASAQDGRCPCGARRPDSRLLQLHITMPFSSPMEAELVRRILSRDAAPLPRPGAVLKDFTVSGNLLFMSVRDQDREGAGRMRVVGWGLGSASPEGQKARDLRTPKHKVSEQRPGTPGPPPPEGAQGDGCRGVAFNVMFSAPHI

SEQ ID NO: 28630 - protein, 180 aa, Homo sapiens
MQAEGQGTGGSTGDADGPGGPGIPDGPGGNAGGPGEAGATGGRGPRGAGAARASGPRGGAPRGPHGGAASAQDGRCPCGARRPDSRLLQLHITMPFSSPMEAELVRRILSRDAAPLPRPGAVLKDFTVSGNLLFIRLTAADHRQLQLSISSCLQQLSLLMWITQCFLPVFLAQAPSGQRR

SEQ ID NO: 28631 - protein, 663 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 28632 - protein, 734 aa, Homo sapiens
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 28633 - protein, 228 aa, Homo sapiens
MPRRGLVAGPDLEYFQRRYFTPAEVAQHNRPEDLWVSYLGRVYDLTSLAQEYKGNLLLKPIVEVAGQDISHWFDPKTRDIRKHIDPLTGCLRYCTPRGRFVHVPPQLPCSDWANDFGKPWWQGSYYEVGRLSAKTRSIRIINTLTSQEHTLEVGVLESIWEILHRYLPYNSHAASYTWKYEGKNLNMDFTLEENGIRDEEEEFDYLSMDGTLHTPAILLYFNDDLTEL

SEQ ID NO: 28634 - protein, 348 aa, Homo sapiens
MSLPRFQRVNFGPYDNYIPVSELSKKSWNQQHFALLFPKPQRPGTKRRSKPSQIRDNTVSIIDEEQLRGDRRQPLWMYRSLMRISERPSVYLAARRQPLKPTRTVEVDSKAAEIGKKGEDKTTQKDTTDSESELKQGKKDSKKGKDIEKGKEEKLDAKKDSKKGKKDAEKGKDSATESEDEKGGAKKDNKKDKKDSNKGKDSATESEGEKGGTEKDSKKGKKDSKKGKDSAIELQAVKADEKKDEDGKKDANKGDESKDAKKDAKEIKKGKKDKKKPSSTDSDSKDDVKKESKKDATKDAKKVAKKDTEKESADSKKDAKKNAKKDAKKDAKKNAKKDEKKDAKKKGK

SEQ ID NO: 28635 - protein, 509 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 28636 - protein, 398 aa, Homo sapiens
MMLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 28637 - protein, 398 aa, Homo sapiens; identical to SEQ ID NO: 28636

SEQ ID NO: 28638 - protein, 295 aa, Homo sapiens
MSTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQAYPTYPNSPVQVITGYQLPVYNYQMPPQWPVGEQRSYVVPPAYSAVNYHCNEVDPGAEVVPNECSVHEATPPSGNGPQKKSVDRSIQTVVSCLFNPENRLRNSVVTQDDYFKDKRVHHFRRSRAMLKSV

SEQ ID NO: 28639 - protein, 674 aa, Homo sapiens
MNSGAMRIHSKGHFQGGIQVKNEKNRPSLKSLKTDNRPEKSKCKPLWGKVFYLDLPSVTISEKLQKDIKDLGGRVEEFLSKDISYLISNKKEAKFAQTLGRISPVPSPESAYTAETTSPHPSHDGSSFKSPDTVCLSRGKLLVEKAIKDHDFIPSNSILSNALSWGVKILHIDDIRYYIEQKKKELYLLKKSSTSVRDGGKRVGSGAQKTRTGRLKKPFVKVEDMSQLYRPFYLQLTNMPFINYSIQKPCSPFDVDKPSSMQKQTQVKLRIQTDGDKYGGTSIQLQLKEKKKKGYCECCLQKYEDLETHLLSEQHRNFAQSNQYQVVDDIVSKLVFDFVEYEKDTPKKKRIKYSVGSLSPVSASVLKKTEQKEKVELQHISQKDCQEDDTTVKEQNFLYKETQETEKKLLFISEPIPHPSNELRGLNEKMSNKCSMLSTAEDDIRQNFTQLPLHKNKQECILDISEHTLSENDLEELRVDHYKCNIQASVHVSDFSTDNSGSQPKQKSDTVLFPAKDLKEKDLHSIFTHDSGLITINSSQEHLTVQAKAPFHTPPEEPNECDFKNMDSLPSGKIHRKVKIILGRNRKENLEPNAEFDKRTEFITQEENRICSSPVQSLLDLFQTSEEKSEFLGFTSYTEKSGICNVLDIWEEENSDNLLTAFFSSPSTSTFTGF

SEQ ID NO: 28640 - protein, 1447 aa, Homo sapiens
MENSLRCVWVPKLAFVLFGASLLSAHLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDPTDPVDYYPLLDDFPTSVPDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDFTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVYEQDDLSEQMASLEGLMKQLNAITGSAF

SEQ ID NO: 28641 - protein, 354 aa, Homo sapiens
MAKTGAEDHREALSQSSLSLLTEAMEVLQQSSPEGTLDGNTVNPIYKYILNDLPREFMSSQAKAVIKTTDDYLQSQFGPNRLVHSAAVSEGSGLQDCSTHQTASDHSHDEISDLDSYKSNSKNNSCSISASKRNRPVSAPVGQLRVAEFSSLKFQSARNWQKLSQRHKLQPRVIKVTAYKNGSRTVFARVTAPTITLLLEECTEKLNLNMAARRVFLADGKEALEPEDIPHEADVYVSTGEPFLNPFKKIKDHLLLIKKVTWTMNGLMLPTDIKRRKTKPVLSIRMKKLTERTSVRILFFKNGMGQDGHEITVGKETMKKVLDTCTIRMNLNLPARYFYDLYGRKIEDISKGKH

SEQ ID NO: 28642 - protein, 1006 aa, Homo sapiens
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKVQTASSANTLWKTNSVSVDGGSRQRSSSDPPAVHPPLPPLRVTSTNPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 28643 - protein, 396 aa, Homo sapiens
MLITVYCVRRDLSEVTFSLQVSPDFELRNFKVLCEAESRVPVEEIQIIHMERLLIEDHCSLGSYGLKDGDIVVLLQKDNVGPRAPGRAPNQPRVDFSGIAVPGTSSSRPQHPGQQQQRTPAAQRSQGLASGEKVAGLQGLGSPALIRSMLLSNPHDLSLLKERNPPLAEALLSGSLETFSQVLMEQQREKALREQERLRLYTADPLDREAQAKIEEEIRQQNIEENMNIAIEEAPESFGQVTMLYINCKVNGHPLKAFVDSGAQMTIMSQACAERCNIMRLVDRRWAGVAKGVGTQRIIGRVHLAQIQIEGDFLQCSFSILEDQPMDMLLGLDMLRRHQCSIDLKKNVLVIGTTGTQTYFLPEGELPLCSRMVSGQDESSDKEITHSVMDSGRKEH

SEQ ID NO: 28644 - protein, 111 aa, Homo sapiens
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTPVSPTG

SEQ ID NO: 28645 - protein, 99 aa, Homo sapiens
MGLFMIIAILLFQKPTVTEQLKKCWNNYVQGHCRKICRVNEVPEALCENGRYCCLNIKELEACKKITKPPRPKPATLALTLQDYVTIIENFPSLKTQST

SEQ ID NO: 28646 - protein, 183 aa, Homo sapiens
MKLLFPIFASLMLQYQVNTEFIGLRRCLMGLGRCRDHCNVDEKEIQKCKMKKCCVGPKVVKLIKNYLQYGTPNVLNEDVQEMLKPAKNSSAVIQRKHILSVLPQIKSTSFFANTNFVIIPNATPMNSATISTMTPGQITYTATSTKSNTKESRDSATASPPPAPPPPNILPTPSLELEEAEEQ

SEQ ID NO: 28647 - protein, 703 aa, Homo sapiens
MAAPVGPVKFWRPGTEGPGVSISEERQSLAENSGTTVVYNPYAALSIEQQRQKLPVFKLRNHILYLIENYQTVVIVGETGCGKSTQIPQYLAEAGWTAEGRVVGVTQPRRVAAVTVAGRVAEERGAVLGHEVGYCIRFDDCTDQLATRIKFLTDGMLVREMMVDPLLTKYSVIMLDEAHERTLYTDIAIGLLKKIQKKRGDLRLIVASATLDADKFRDFFNQNETSDPARDTCVILTVEGRTFPVDIFYLQSPVPDYIKSTVETVVKIHQTEGDGDVLAFLTGQEEVETVVSMLIEQARALARTGMKRHLRVLPMYAGLPSFEQMKVFERVSRSVRKVIVATNVAETSITISGIVYVIDCGFVKLRAYNPRTAIECLVVVPVSQASANQRAGRGGRSRSGKCYRLYTEEAFDKLPQSTVPEMQRSNLAPVILQLKALGIDNVLRFHFMSPPPAQSMVQALELLYALGGLDKDCRLTEPLGMRIAEFPLNPMFAKMLLESGNFGCSQEILSIAAMMQIQNIFVVPPNQKSHAIRVHRKFAVEEGDHLTMLNIYEAFIKHNKDSKWCQEHFLNYKGLVRAATVREQLKKLLVKFQVPRKSSEGDPDLVLRCIVSGFFANAARFHSTGAYRTIRDDHELHIHPASVLYAEKPPRWVIYNEVIQTSKYYMRDVTAIESAWLLELAPHFYQQGTHLSLKAKRAKVQDP

SEQ ID NO: 28648 - protein, 1475 aa, Homo sapiens
  VARIANT 511, 538, 556, 615, 624, 632, 641, 650, 686, 695, 704, 712,721, 748, 757, 809, 817, 818, 826, 834, 835, 843, 852, 861,870, 871, 879, 888, 897, 905, 906, 941, 950, 951, 1003,1012, 1021, 1030, 1039, 1048, 1057, 1058, 1066, 1084, 1086: Xaa = Any Amino Acid
  VARIANT 1093, 1102, 1110, 1111, 1119, 1120, 1164, 1217, 1226, 1279,1315, 1339, 1357, 1358, 1366, 1393, 1402, 1411, 1420, 1429,1438, 1447, 1456, 1465, 1474: Xaa = Any Amino Acid
MGNLCCCIQGDSKNSSKKRVKREPYSTTKVTSGSTFNENTRRYAVHTNQCRRPHGSPVKKKMYPQEDDFHHTIFSNLERLDKLQPTLEASEESLVHKDRGDGERPVNVRVVQVAPLRRESTPHGDTIHDITNEDAVHDTTDEDAVHGTADEDAVQGIADEDAVHGIADWDAIQGLADRDAVHGFADGDAVKGIADGDATQGIAEGDDVHGIADGVAVQGIADEDAVQLIADEDPVHGITKEDATQGFANKDAAQGIANEEAIHGIPNEVAIQGVANDDAVQGGIANEDATQGIANDDAVHGITNEDTAQGIANWDAVQDIANWDAVHCIANEDGFHGIDNEDAVQGIADWDAAQGIADGVAAQGIALDDAVHGIANKDAAQGIANWDAVQDIANEDGFHGIDNEDAVQGIANWDVVQGIANWDTVHSFADGVAFHGIADGDAVQGIALDDAVHGIANEDAAQGIANWDAVQDIANEDGFHGIDIEDAAQGIDNEDAFQGHRRRGRRPRHRXRGCRPRHRRLGRRPGHRRRGRRPRHRXRGSRPGHRQLGCCPGHQXRRWIPRHRQRGRHPGHRRRGRRPGHRRRGRRPGHRRLGHSPRLRQQGRHPRLRQQGHRXRGGRPRHPXGRRPEHRXRGRRPGHRXRRWSPRHRXRGHHPGPRRRGRRPRPRRRGRRPRPWRWGRRPGQRXRGRRPGHRXRGRRPGHRXRRRPGHRXRGRHPRYCXRGCRPVHRQLGCRPGHRQLGCRPVHCXRRWIPQHRXQGRRPGHRRRRRRPGHRRRGRRPGHRRRGRRPGHRRRGRRPGHRRRGRRHRXRRRPGHRXXGLRPGHRXRRRPGHRXXGRRPGHRXRGPCPWHHXRGCHPGLCXQGRRPGHHXXGRRPGHRXRGGHPRHPXRGRRPGRRXRRWSPWHXXRGRRPGHRRGRHPGHHQLGRRPGHCQLGRRPGHRXRRWIPRHRXXGRRPVHRRGRRPGHRHLARRPGHRHLARRPGHRQLGRRPGHRRQGRRPWLCXRGCRPRLRXRGRRQGHRXRECRPGHRXWGRPPRHRXRCRHPGHRXQGRHPGHRXXGGRPQRHXRGRRPGHRQRGCHPGHRXRXHRSGHRXQRWSLRHCXGRCPGHRXXGRRPGHRXXGHHPGHRQRGSRPGHRRGRHPGHRQRGGCPGHRQWGRRTGHRQXGRHPGHRQLGRRPRLRQRGRRPQLRQRGRRPGHRQRGRHQGHGQRGHHPRHRXRGRRPGHRXRGGRPGHRQRGRRPGNRRGCRTGHRQRGRRPGHRQQGGRPGHRQRGRRPGNRXGRRTGHRQRGCRPGHRQRGGRPGHRQQGRRPGHRQXRHPGHRRGHRPGLRQRRRRPGHRXRGRRPGHRQRRRRPGHRXXRWSPRYRXRGHRPGHRQLGLRPGPRRRGRRPGPRXLGRRPGPRXRGRRQGHRXSGRRQGHRXRGRRPGHPXRGRRPRHRXRGHHPGHRXRGRSPAHRXRGPRPWHHXRGRRPGHHXL

SEQ ID NO: 28649 - protein, 647 aa, Homo sapiens
MGPLSARLLMQRGRPKSDRLGKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 28650 - protein, 102 aa, Homo sapiens
MKKRHREGCDMPGPWSTLRSHRGHHCPHLHPVLRRPTLTDVEGCLQCLDVCGHPRHAVDAHLLHASALDLLHALAHDVGHLGPLSPAGGGNVLSVLTALLGP

SEQ ID NO: 28651 - protein, 160 aa, Homo sapiens
MMNNTDFLMLNNPWNKLCLVSMDFCFPLDFVSNLFWIFASKFIIVTGQIKADFKRTSWEAKAEGSLEPGRLKLQLASIVPLYSSLVTAGPASKIIILKRTSLPTVSPSNERAYLLPVSFTDLAHVFYLSYFSINAKSNSFSLDIIIALGIPHNTQAHFNH

SEQ ID NO: 28652 - protein, 135 aa, Homo sapiens
MRGLGGEGGTEEESSLGQAGGKLKTAAWPSWVAEVGAAGALADPGGQKSGSFLPSQDSHKDFRGSWQLLHFQLPDPSHFPLPTNSNLGPSRGKQLQPSLTPLQMETCAPGCEHFKGCHTGHTLRCLDSFDERAKP

SEQ ID NO: 28653 - protein, 164 aa, Homo sapiens
MSGSPQASYPQTHSFTLKHQEIRTFWNLNMRGLGGEGGTEEESSLGQAGGKLKTAAWPSWVAEVGAAGALADPGGQKSGSFLPSQDSHKDFRGSWQLLHFQLPDPSHFPLPTNSNLGPSRGKQLQPSLTPLQMETCAPGCEHFKGCHTGHTLRCLDSFDERAKP

SEQ ID NO: 28654 - protein, 164 aa, Homo sapiens
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRYQYKGSRTQCHSLEPRKQALFKTKQNKQKKPLTCHIKASECLKYVQYE

SEQ ID NO: 28655 - protein, 1925 aa, Homo sapiens
MFTLTGCRLVEKTQKVENPSVSFASSFPLIPLLLRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVLQSYSNIEEDCTMCPSWCLTVRARGHSYFAGFEHHIPQYSLDVPKLFPAVSSGEPTYRSLLLVNKDCKLLTFSLAPQRGSDVILRPTSGLVAPGAHQIILICTYPEGSSWKQHTFYLQCNASPQYLKEVSMYSREEPLQLKLDTHKSLYFKPTWVGCSSTSPFTFRNPSRLPLQFEWRVSEQHRKLLAVQPSRGLIQPNERLTLTWTFSPLEETKYLFQVGMWVWEAGLSPNANPAATTHYMLRLVGVGLTSSLSAKEKELAFGNVLVNSKQSRFLVLLNDGNCTLYYRLYLEQGSPEAVDNHPLALQLDRTEGSMPPRSQDTICLTACPKQRSQYSWTITYSLLSHRDNKAGEKQELCCVSLVAVYPLLSILDVSSMGSAEGITRKHLWRLFSLDLLNSYLERDPTPCELTYKVPTRHSMSQIPPVLTPLRLDFNFGAAPFKAPPSVVFLALKNSGVVSLDWAFLLPSDQRIDVELWAEQAELNSTELHQMRVQDNCLFSISPKAGSLSPGQEQMVELKYSHLFIGTDHLPVLFKVSHGREILLNFIGVTVKPEQKYVHFTSTTHQFIPIPIGDTLPPRQIYELYNGGSVPVTYEVQTDVLSQVQEKNFDHPIFCCLNPKGEIQPGSTARVLWIFSPIEAKTYTVDVPIHILGWNSALIHFQGVGYNPHMMGDTAPFHNISSWDNSSIHSRLVVPGQNVFLSQSHISLGNIPVQSKCSRLLFLNNISKNEEIAFSWQPSPLDFGEVSVSPMIGVVAPEETVPFVVTLRASVHASFYSADLVCKLYSQQLMRQYHKELQEWKDEKVRQEVEFTITDMKVKKRTCCTACEPARKYKTLPPIKNQQSVSRPASWKLQTPKEEVSWPCPQPPSPGMLCLGLTARAHATDYFLANFFSEFPCHFLHRELPKRKAPREESETSEEKSPNKWGPVSKQKKQLLVDILTTIIRGLLEDKNFHEAVDQSLVEQVPYFRQFWNEQSTKFMDQKNSLYLMPILPVPSSSWEDGKGKQPKEDRPEHYPGLGKKEEGEEEKGEEEEEELEEEEEEEEETEEEELGKEEIEEKEEERDEKEEKVSWAGIGPTPQPESQESMQWQWQQQLNVMVKEEQEQDEKEAIRRLPAFANLQEALLENMIQNILVEASRGEVVLTSRPRVIALPPFCVPRSLTPDTLLPTQQAEVLHPVVPLPTDLP

SEQ ID NO: 28656 - protein, 1809 aa, Homo sapiens
  VARIANT 518: Xaa = Any Amino Acid
MPSDSESSSSLSSVGTTGKAPSPPPLLTDRQVNEKVENLSIQLRLMTRERNELRKRLAFATHGTAFDKRPYHRLNPDYERLKIQCVRAMSDLQSLQNQHTNALKRCEEVAKETDFYHTLHSRLLSDQTRLKDDVDMLRRENGQLLRERNLLQQSWEDMKRLHEEDQKEIGDLRAQQQQVLKHNGSSEILNKLYDTAMDKLEVVKKDYDALRKRYSEKVAIHNADLSRLEQLGEENQRLLKQTEMLTQQRDTAIQLQHQCALSLRRFEAIHHELNKATAQNKDLQWEMELLQSELTELRTTQVKTAKESEKYREERDAVYSEYKLIMSERDQVISELDKLQTEVELAESKLKSSTSEKKAANEEMEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETXDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 28657 - protein, 342 aa, Homo sapiens
MADKMVRTPKCSRCRNHGFLVPVKGHAGKCRWKQCLCEKCYLISERQKIMAAQKVLKTQAAEEEQEAALCAQGPKQASGAAAAAPAPVPVPAASLRPLSPGTPSGDADPGPEGRAAACFFEQPPRGRNPGPRALQPVLGGRSHVEPSERAAVAMPSLAGPPFGAEAAGSGYPGPLDLRRPMRTVPGPLFTDFVRPLNINPDRALGPEYPGGSSMHPYCPFPLGYLDAPPGVPLQQGFRHVSRSQYQGGGLVSEPGGDFQPSYYLPPPPPPLPPLPPLPPQPQFLPPGYLSALHFLPPPPPPPPPSSFSLTVLFDTDKENTDDQDAEVLSGEPSQPSSQEQSD

SEQ ID NO: 28658 - protein, 224 aa, Homo sapiens
MEPSDMPAGYHCPLDSAPWDETRDPQSTELIPRRAISRSPTCARCRNHGVTAHLKGHKRLCLFQACECHKCVHILERRRVMAAQVALRRQQEAQLKKHLMRRGEASPKAPNHFRKGTTQPQVPSGKENIAPQPQTPHGAVLLAPTPPGKPCTQLQPVPSAPAELLWASAAQPSPGSLALVLDSGASWPLGPWTLAASRLLHATTSGVPPAVPRTCCLSASLPWL

SEQ ID NO: 28659 - protein, 4624 aa, Homo sapiens
MFRIGRRQLWKHSVTRVLTQRLKGEKEAKRALLDARHNYLFAIVASCLDLNKTEVEDAILEGNQIERIDQLFAVGGLRHLMFYYQDVEEAETGQLGSLGGVNLVSGKIKKPKVFVTEGNDVALTGVCVFFIRTDPSKAITPDNIHQEVSFNMLDAADGGLLNSVRRLLSDIFIPALRATSHGWGELEGLQDAANIRQEFLSSLEGFVNVLSGAQESLKEKVNLRKCDILELKTLKEPTDYLTLANNPETLGKIEDCMKVWIKQTEQVLAENNQLLKEADDVGPRAELEHWKKRLSKFNYLLEQLKSPDVKAVLAVLAAAKSKLLKTWREMDIRITDATNEAKDNVKYLYTLEKCCDPLYSSDPLSMMDAIPTLINAIKMIYSISHYYNTSEKITSLFVKVTNQIISACKAYITNNGTASIWNQPQDVVEEKILSAIKLKQEYQLCFHKTKQKLKQNPNAKQFDFSEMYIFGKFETFHRRLAKIIDIFTTLKTYSVLQDSTIEGLEDMATKYQGIVATIKKKEYNFLDQRKMDFDQDYEEFCKQTNDLHNELRKFMDVTFAKIQNTNQALRMLKKFERLNIPNLGIDDKYQLILENYGADIDMISKLYTKQKYDPPLARNQPPIAGKILWARQLFHRIQQPMQLFQQHPAVLSTAEAKPIIRSYNRMAKVLLEFEVLFHRAWLRQIEEIHVGLEASLLVKAPGTGELFVNFDPQILILFRETECMAQMGLEVSPLATSLFQKRDRYKRNFSNMKMMLAEYQRVKSKIPAAIEQLIVPHLAKVDEALQPGLAALTWTSLNIEAYLENTFAKIKDLELLLDRVNDLIEFRIDAILEEMSSTPLCQLPQEEPLTCEEFLQMTKDLCVNGAQILHFKSSLVEEAVNELVNMLLDVEVLSEEESEKISNENSVNYKNESSAKREEGNFDTLTSSINARANALLLTTVTRKKKETEMLGEEARELLSHFNHQNMDALLKVTRNTLEAIRKRIHSSHTINFRDSNSASNMKQNSLPIFRASVTLAIPNIVMAPALEDVQQTLNKAVECIISVPKGVRQWSSELLSKKKIQERKMAALQSNEDSDSDVEMGENELQDTLEIASVNLPIPVQTKNYYKNVSENKEIVKLVSVLSTIINSTKKEVITSMDCFKRYNHIWQKGKEEAIKTFITQSPLLSEFESQILYFQNLEQEINAEPEYVCVGSIALYTADLKFALTAETKAWMVVIGRHCNKKYRSEMENIFMLIEEFNKKLNRPIKDLDDIRIAMAALKEIREEQISIDFQVGPIEESYALLNRYGLLIAREEIDKVDTLHYAWEKLLARAGEVQNKLVSLQPSFKKELISAVEVFLQDCHQFYLDYDLNGPMASGLKPQEASDRLIMFQNQFDNIYRKYITYTGGEELFGLPATQYPQLLEIKKQLNLLQKIYTLYNSVIETVNSYYDILWSEVNIEKINNELLEFQNRCRKLPRALKDWQAFLDLKKIIDDFSECCPLLEYMASKAMMERHWERITTLTGHSLDVGNESFKLRNIMEAPLLKYKEEIEDICISAVKERDIEQKLKQVINEWDNKTFTFGSFKTRGELLLRGDSTSEIIANMEDSLMLLGSLLSNRYNMPFKAQIQKWVQYLSNSTDIIESWMTVQNLWIYLEAVFVGGDIAKQLPKEAKRFSNIDKSWVKIMTRAHEVPSVVQCCVGDETLGQLLPHLLDQLEICQKSLTGYLEKKRLCFPRFFFVSDPALLEILGQASDSHTIQAHLLNVFDNIKSVKFHEKIYDRILSISSQEGETIELDKPVMAEGNVEVWLNSLLEESQSSLHLVIRQAAANIQETGFQLTEFLSSFPAQVGLLGIQMIWTRDSEEALRNAKFDKKIMQKTNQAFLELLNTLIDVTTRDLSSTERVKYETLITIHVHQRDIFDDLCHMHIKSPMDFEWLKQCRFYFNEDSDKMMIHITDVAFIYQNEFLGCTDRLVITPLTDRCYITLAQALGMSMGGAPAGPAGTGKTETTKDMGRCLGKYVVVFNCSDQMDFRGLGRIFKGLAQSGSWGCFDEFNRIDLPVLSVAAQQISIILTCKKEHKKSFIFTDGDNVTMNPEFGLFLTMNPGYAGRQELPENLKINFRSVAMMVPDRQIIIRVKLASCGFIDNVVLARKFFTLYKLCEEQLSKQVHYDFGLRNILSVLRTLGAAKRANPMDTESTIVMRVLRDMNLSKLIDEDEPLFLSLIEDLFPNILLDKAGYPELEAAISRQVEEAGLINHPPWKLKVIQLFETQRVRHGMMTLGPSGAGKTTCIHTLMRAMTDCGKPHREMRMNPKAITAPQMFGRLDVATNDWTDGIFSTLWRKTLRAKKGEHIWIILDGPVDAIWIENLNSVLDDNKTLTLANGDRIPMAPNCKIIFEPHNIDNASPATVSRNGMVFMSSSILDWSPILEGFLKKRSPQEAEILRQLYTESFPDLYRFCIQNLEYKMEVLEAFVITQSINMLQGLIPLKEQGGEVSQAHLGRLFVFALLWSAGAALELDGRRRLELWLRSRPTGTLELPPPAGPGDTAFDYYVAPDGTWTHWNTRTQEYLYPSDTTPEYGSILVPNVDNVRTDFLIQTIAKQGKAVLLIGEQGTAKTVIIKGFMSKYDPECHMIKSLNFSSATTPLMFQRTIESYVDKRMGTTYGPPAGKKMTVFIDDVNMPIINEWGDQVTNEIVRQLMEQNGFYNLEKPGEFTSIVDIQFLAAMIHPGGGRNDIPQRLKRQFSIFNCTLPSEASVDKIFGVIGVGHYCTQRGFSEEVRDSVTKLVPLTRRLWQMTKIKMLPTPAKFHYVFNLRDLSRVWQGMLNTTSEVIKEPNDLLKLWKHECKRVIADRFTVSSDVTWFDKALVSLVEEEFGEEKKLLVDCGIDTYFVDFLRDAPEAAGETSEEADAETPKIYEPIESFSHLKERLNMFLQLYNESIRGAGMDMVFFADAMVHLVKISRVIRTPQGNALLVGVGGSGKQSLTRLASFIAGYVSFQITLTRSYNTSNLMEDLKVLYRTAGQQGKGITFIFTDNEIKDESFLEYMNNVLSSGEVSNLFARDEIDEINSDLASVMKKEFPRCLPTNENLHDYFMSRVRQNLHIVLCFSPVGEKFRNRALKFPALISGCTIDWFSRWPKDALVAVSEHFLTSYDIDCSLEIKKEVVQCMGSFQDGVAEKCVDYFQRFRRSTHVTPKSYLSFIQGYKFIYGEKHVEVRTLANRMNTGLEKLKEASESVAALSKELEAKEKELQVANDKADMVLKEVTMKAQAAEKVKAEVQKVKDRAQAIVDSISKDKAIAEEKLEAAKPALEEAEAALQTIRPSDIATVRTLGRPPHLIMRIMDCVLLLFQRKVSAVKIDLEKSCTMPSWQESLKLMTAGNFLQNLQQFPKDTINEEVIEFLSPYFEMPDYNIETAKRVCGNVAGLCSWTKAMASFFSINKEVLPLKANLVVQENRHLLAMQDLQKAQAELDDKQAELDVVQAEYEQAMTEKQTLLEDAERCRHKMQTASTLISGLAGEKERWTEQSQEFAAQTKRLVGDVLLATAFLSYSGPFNQEFRDLLLNDWRKEMKARKIPFGKNLNLSEMLIDAPTISEWNLQGLPNDDLSIQNGIIVTKASRYPLLIDPQTQGKIWIKNKESRNELQITSLNHKYFRNHLEDSLSLGRPLLIEDVGEELDPALDNVLERNFIKTGSTFKVKVGDKEVDVLDGFRLYITTKLPNPAYTPEISARTSIIDFTVTMKGLEDQLLGRVILTEKQELEKERTHLMEDVTANKRRMKELEDNLLYRLTSTQGSLVEDESLIVVLSNTKRTAEEVTQKLEISAETEVQINSAREEYRPVATRGSILYFLITEMRLVNEMYQTSLRQFLGLFDLSLARSVKSPITSKRIANIIEHMTYEVYKYAARGLYEEHKFLFTLLLTLKIDIQRNRVKHEEFLTLIKGGASLDLKACPPKPSKWILDITWLNLVELSKLRQFSDVLDQISRNEKMWKIWFDKENPEEEPLPNAYDKSLDCFRRLLLIRSWCPDRTIAQARKYIVDSMGEKYAEGVILDLEKTWEESDPRTPLICLLSMGSDPTDSIIALGKRLKIETRYVSMGQGQEVHARKLLQQTMANGGWALLQNCHLGLDFMDELMDIIIETELVHDAFRLWMTTEAHKQFPITLLQMSIKFANDPPQGLRAGLKRTYSGVSQDLLDVSSGSQWKPMLYAVAFLHSTVQERRKFGALGWNIPYEFNQADFNATVQFIQNHLDDMDVKKGVSWTTIRYMIGEIQYGGRVTDDYDKRLLNTFAKVWFSENMFGPDFSFYQGYNIPKCSTVDNYLQYIQSLPAYDSPEVFGLHPNADITYQSKLAKDVLDTILGIQPKDTSGGGDETREAVVARLADDMLEKLPPDYVPFEVKERLQKMGPFQPMNIFLRQEIDRMQRVLSLVRSTLTELKLAIDGTIIMSENLRDALDCMFDARIPAWWKKASWISSTLGFWFTELIERNSQFTSWVFNGRPHCFWMTGFFNPQGFLTAMRQEITRANKGWALDNMVLCNEVTKWMKDDISAPPTEGVYVYGLYLEGAGWDKRNMKLIESKPKVLFELMPVIRIYAENNTLRDPRFYSCPIYKKPVRTDLNYIAAVDLRTAQTPEHWVLRGVALLCDVK

SEQ ID NO: 28660 - protein, 4490 aa, Homo sapiens
MMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWVREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETEEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVKVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHTKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQIIMRVKLASCGFLENVILAQKFYVLYKLCEEQLTKQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNRKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGDRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISVLRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 28661 - protein, 400 aa, Homo sapiens
MRGRRGDRMTINIQEHMAINVCPGPIRPIRQISDYFPRGPGPEGGGGGGGEAPAHLVPLALAPPAALLGATTPEDGAEVDSYDSDDATALGTLEFDLLYDRASCTLHCSILRAKGLKPMDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVPLASPSSMSAALRGISCYLKELEQAEQGQGLLEERGRILLSLSYSSRRRGLLVGILRCAHLAAMDVNGYSDPYVKTYLRPDVDKKSKHKTCVKKKTLNPEFNEEFFYEIELSTLATKTLEVTVWDYDIGKSNDFIGGVSLGPGARGEARKHWSDCLQQPDAALERWHTLTSELPPAAGALSSA

SEQ ID NO: 28662 - protein, 758 aa, Homo sapiens
MRKQGVSSKRLQSSGRSQSKGRRGASLAREPEVEEEVEKSVLGGGKLPRGAWRSSPGRIQSLKERKGLELEVVAKTFLLGPFQFVRNSLAQLREKVQELQARRFSSRTTLGIAVFVAILHWLHLVTLFENDRHFSHLSSLEREMTFRTEMGLYYSYFKTIIEAPSFLEGLWMIMNDRLTEYPLIINAIKRFHLYPEVIIASWYCTFMGIMNLFGLETKTCWNVTRIEPLNEVQSCEGLGDPACFYVGVIFILNGLMMGLFFMYGAYLSGTQLGGLITVLCFFFNHGEATRVMWTPPLRESFSYPFLVLQMCILTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRKQLLEHSELAFHTLQLLVFTALAILIMRLKMFLTPHMCVMASLICSRQLFGWLFRRVRFEKVIFGILTVMSIQGYANLRNQWSIIGEFNNLPQEELLQWIKYSTTSDAVFAGAMPTMASIKLSTLHPIVNHPHYEDADLRARTKIVYSTYSRKSAKEVRDKLLELHVNYYVLEEAWCVVRTKPGCSMLEIWDVEDPSNAANPPLCSVLLEDARPYFTTVFQNSVYRVLKVN

SEQ ID NO: 28663 - protein, 91 aa, Homo sapiens
MKEPGPNFVTVRKGLHSFKMAFVKHLLLECSGSITDHCSLHLPVQEILMSQPPEQLGLQTNLGNQESSGMMKLFMPRPKVLAQYESIQFMP

SEQ ID NO: 28664 - protein, 37 aa, Homo sapiens
MKEPGPNFVTVRKGLHSFKMAFVKHLLQTLEIKKVLE

SEQ ID NO: 28665 - protein, 27 aa, Homo sapiens
MKEPGPNFVTVRKGLHSFKMAFVKHLL

SEQ ID NO: 28666 - protein, 188 aa, Homo sapiens
MAETSLPELGGEDKATPCPSILELEELLRAGKSSCSRVDEVWPNLFIGDAATANNRFELWKLGITHVLNAAHKGLYCQGGPDFYGSSVSYLGVPAHDLPDFDISAYFSSAADFIHRALNTPGAKVLVHCVVGVSRSATLVLAYLMLHQRLSLRQAVITVRQHRWVFPNRGFLHQLCRLDQQLRGAGQS

SEQ ID NO: 28667 - protein, 248 aa, Homo sapiens
MAETSLPELGGEDKATPCPSILELEELLRAGKSSCSRVDEVWPNLFIGDAMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 28668 - protein, 291 aa, Homo sapiens
MGLCHFATLALILLVLLEALAQADTQKMVEAQRGVGPRACYSIWLLLAPTPPLSHCLQSPQKQHQVCGDRRLKASSTNCPSEKCTAWARYSHRMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 28669 - protein, 166 aa, Homo sapiens
MAETSLPELGGEDKATPCPSILELEELLRAGKSSCSRVDEVWPNLFIGDAATANNRFELWKLGITHVLNAAHKGLYCQGGPDFYGSSVSYLGVPAHDLPDFDISAYFSSAADFIHRALNTPGELVLTPCHGALPLCHPGTDPAGAAGGSGPGGHTEDGGSPAWGRP

SEQ ID NO: 28670 - protein, 60 aa, Homo sapiens
MAETSLPELGGEDKATPCPSILELEELLRAGKSSCSRVDEVWPNLFIGDANSIKCAETGG

SEQ ID NO: 28671 - protein, 198 aa, Homo sapiens
MDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 28672 - protein, 190 aa, Homo sapiens
MTASASSFSSSQGVQQPSIYSFSQITRSLFLSNGVAANDKLLLSSNRITAIVNASVEVVNVFFEGIQYIKVPVTDARDSRLYDFFDPIADLIHTIDMRQGRTLLHCMAGVSRSASLCLAYLMKYHSMSLLDAHTWTKSRRPIIRPNNGFWEQLINYEFKLFNNNTVRMINSPVGNIPDIYEKDLRTMISM

SEQ ID NO: 28673 - protein, 177 aa, Homo sapiens
MESIYLQKHLGACLTQGLAEVARVRPVDPIEYLALWIYKYKENVTMEQLRQKEMAKLERERELALMEQEMMERLKAEELLLQQQQLALQLELEMQEKERQRIQELQRAQEQLGKEMRMNMENLVRNEDILHSEEATLDSGKTLAEISDRYGAPNLSRVEELDEPMFSDIALNIDQDL

SEQ ID NO: 28674 - protein, 96 aa, Homo sapiens
MAEVEETLKRIQSHKGVIGTMVVNAEGIPIRTTLDNSTTVQYAGLLHHLTMKAKSTVRDIDPQNDLTFLRIRSKKHEIMVAPDKEYLLIVIQNPCE

SEQ ID NO: 28675 - protein, 568 aa, Homo sapiens
MKWKEKLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPASAFQGLGSKLPPVVGIANKLKANLMSETNGSIPLCSVLPKLIS

SEQ ID NO: 28676 - protein, 588 aa, Homo sapiens
MGGTARGPGRKDAGPPGAGLPPQQRRLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPASAFQGLGSKLPPVVGIANKLKANLMSETNGSIPLCSVLPKLIS

SEQ ID NO: 28677 - protein, 911 aa, Homo sapiens
MEVNCLTLKDLISPRQPRLDFAVEDGENAQKENIFVDRSRMAPKTPIKNEPIDLSKQKKFTPERNPITPVKLVDRQQAEPWTPTANLKMLISAASPDIRDREKKKGLFRPIENKDDAFTDSLQLDVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSSSANSRKDKSLRIMSQKFVMLFLVSKTKIVTLDVAAKILIEESQDAPDHSKFKTKVRRLYDIANVLTSLALIKKVHVTEERGRKPAFKWIGPVDFSSSDEELVDVSASVLPELKRETYGQIQVCAKQKLARHGSFNTVQASERIQRKVNSEPSSPYREEQGSGGYSLEIGSLAAVYRQKIEDNSQGKAFASKRVVPPSSSLDPVAPFPVLSVDPEYCVNPLAHPVFSVAQTDLQAFSMQNGLNGQVDVSLASAASAVESLKPALLAGQPLVYVPSASLFMLYGSLQEGPASGSGSERDDRSSEAPATVELSSAPSAQKRLCEERKPQEEDEPATKRQSREYEDGPLSLVMPKKPSDSTDLASPKTMGNRASIPLKDIHVNGQLPAAEEISGKATANSLVSSEWGNPSRNTDVEKPSKENESTKEPSLLQYLCVQSPAGLNGFNVLLSGSQTPPTVGPSSGQLPSFSVPCMVLPSPPLGPFPVLYSPAMPGPVSSTLGALPNTGPVNFSLPGLGSIAQLLVGPTAVVNPKSSTLPSADPQLQSQPSLNLSPVMSRSHSVVQQPESPVYVGHPVSVVKLHQSPVPVTPKSIQRTHRETFFKTPGSLGDPVLKRRERNQSRNTSSAQRRLEIPSGGAD

SEQ ID NO: 28678 - protein, 1414 aa, Homo sapiens
MRTPFNLGETGWLDPQGSECLDYGSQINSFRLGEPCQLKSSWEEIQDQEPFQKLQFCKGGFQRTQPHAAPLSLRGTGECPWGLQGSPAGCKRENHATPSRASQGLRASVLLATAWRCALRCWAVGWTTWSPTPQGLLSVRGHPVGAGGPRPGRQGSRSEGLVTARTERIASSRPRGPRGLLGTRSVGHLPRGAQALKVEGRNALAAGAWPGRTQPASPATVGDFQGEGAHLPSGARRMLQLLVLKIEDPGCFWVIIKGCSPFLDHDVDYQKLNSAMNDFYNSTCQDIEIKPLTLEEGQVCVVYCEELKCWCRAIVKSITSSADQYLAECFLVDFAKNIPVKSKNIRVVVESFMQLPYRAKKFSLYCTKPVTLHIDFCRDSTDIVPAKKWDNAAIQYFQNLLKATTQVEARLCAVEEDTFEVYLYVTIKDEKVCVNDDLVAKNYACYMSPTKNKNLDYLEKPRLNIKSAPSFNKLNPALTLWPMFLQGKDVQGMEDSHGVNFPAQSLQHTWCKGIVGDLRPTATAQDKAVKCNMDSLRDSPKDKSEKKHHCISLKDTNKRVESSVYWPAKRGITIYADPDVPEASALSQKSNEKPLRLTEKKEYDEKNSCVKLLQFLNPDPLRADGISDLQQLQKLKGLQPPVVVLRNKIKPCLTIDSSPLSADLKKALQRNKFPGPSHTESYSWPPIARGCDVVVISHCESNPLLYLLPVLTVLQTGACYKSLPSRNGPLAVIVCPGWKKAQFIFELLGEYSMSSRPLHPVLLTIGLHKEEAKNTKLPRGCDVIVTTPYSLLRLLACQSLLFLRLCHLILDEVEVLFLEANEQMFAILDNFKKNIEVEERESAPHQIVAVGVHWNKHIEHLIKEFMNDPYIVITAMEEAALYGNVQQVVHLCLECEKTSSLLQALDFIPSQAQKTLIFTCSVAETEIVCKVVESSSIFCLKMHKEMIFNLQNVLEQWKKKLSSGSQIILALTDDCVPLLAITDATCVIHFSFPASPKVFGGRLYCMSDHFHAEQGSPAEQGDKKAKSVLLLTEKDASHAVGVLRYLERADAKVPAELYEFTAGVLEAKEDKKAGRPLCPYLKAFGFCKDKRICPDRHRINPETDLPRKLSSQALPSFGYIKIIPFYILNATNYFGRIVDKHMDLYATLNAEMNEYFKDSNKTTVEKVEKFGLYGLAEKTLFHRVQVLEVNQKEDAWALDDILVEFIDEGRTGLVTRDQLLHLPEHFHTLPPQAVEFIVCRVKPADNEIEWNPKVTRYIHHKIVGKLHDAKVILALGNTVWIDPMVHITNLSSLKTSVIDYNVRAEILSMGMGIDNPEHIEQLKKLREDAKIPACEESLSQTPPRVTGTSPAQDQDHPSEEQGGQGTPPAEDAACLQSPQPEDTGAEGGAESKTSSENQKPGGYLVFKRWLSSNR

SEQ ID NO: 28679 - protein, 1414 aa, Homo sapiens; identical to SEQ ID NO: 28678

SEQ ID NO: 28680 - protein, 333 aa, Homo sapiens
MKMDVSVRAAGCSDDLSSGEADVDPKLLELTADEEKCRSIRRQYRQLMYCVRQNREDIVSSANNSLTEALEEANVLFDGVSRTREAALDARFLVMASDLGKEKAKQLNSDMNFFNQLAFCDFLFLFVGLNWMEGDPDKLSDCDDSIALSFWKAIEKEATSWMVKAETFHFVFGSFKLERSAPKPRLEHQKKVRKMEENGNMPTKLQKLDLSSYPEATEKNVERILGLLQTYFRKYPDTPVSYFEFVIDPNSFSRTVENIFYVSFIVRDGFARIRLDEDRLPILEPMNVNQMGEGNDSSCHGRKQGVISLTLQEWKNIVAAFEISEAMITYSSY

SEQ ID NO: 28681 - protein, 1382 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 28682 - protein, 326 aa, Homo sapiens
MSNGYEDHMAEDCRGDIGRTNLIVNYLPQNMTQDELRSLFSSIGEVESAKLIRDKVAGHSLGYGFVNYVTAKDAERAINTLNGLRLQSKTIKVSYARPSSEVIKDANLYISGLPRTMTQKDVEDMFSRFGRIINSRVLVDQTTGLSRGVAFIRFDKRSEAEEAITSFNGHKPPGSSEPITVKFAANPNQNKNVALLSQLYHSPARRFGGPVHHQAQRFRFSPMGVDHMSGLSGVNVPGNASSGWCIFIYNLGQDADEGILWQMFGPFGAVTNVKVIRDFNTNKCKGFGFVTMTNYEEAAMAIASLNGYRLGDKILQVSFKTNKSHK

SEQ ID NO: 28683 - protein, 431 aa, Homo sapiens
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLSPARLQGANTLFQFPSVLNSHGPFTLSGLDGPSTPGPFSPDLQKT

SEQ ID NO: 28684 - protein, 405 aa, Homo sapiens
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQVACSLFMVSPLLSFICPFKQIQNLYTQVCFLLLRFVLERLCVTVM

SEQ ID NO: 28685 - protein, 621 aa, Homo sapiens
MAALKEDRSYGLSCGRVSDGSKVSVFHVKLTDSALRAFESYRARQDSVSLRPSIRFQGSQGHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYETTRGQILQEYRKIKKTNTNYSQEKHRCEYLHSKLAHIKRLIAEYDQRQLQAWP

SEQ ID NO: 28686 - protein, 543 aa, Homo sapiens
MVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAAHHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADCAFSTFPSFGSVGAWLEALDLCRYKDSFAAAGYGSLEAVAEMTAQDLVSLGISLAEHREALLSGISALQARVLQLQGQGVQDNKNLSVIWCLFEWQLLDHCIAGVEGLLPPSSRTGVSRICV

SEQ ID NO: 28687 - protein, 864 aa, Homo sapiens
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKPPPSGPFTSSLGGAGFSDDPFKSKQDTPALPPKKPAPPRPKPPSGKSTPVSQLGSADFPEAPDPFQPLGADSGDPFQSKKGFGDPFSGKDPFVPSSAAKPSKASASGFADFTSVS

SEQ ID NO: 28688 - protein, 396 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 28689 - protein, 338 aa, Homo sapiens
MLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 28690 - protein, 205 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGIFILFQTATTLSKRFNKKKRY

SEQ ID NO: 28691 - protein, 1879 aa, Homo sapiens
MGQTKSKIKSKYASYLSFIKILLKRGGVKVSTKNLIKLFQIIEQFCPWFPEQGTLDLKDWKRIGKELKQAGRKGNIIPLTVWNDWAIIKAALEPFQTEEDSVSVSDAPGSCIIDCNENTRKKSQKETEGLHCEYVAEPVMAQSTQNVDYNQLQEVIYPETLKLEGKGPELVGPSESKPRGTSPLPAGQVPVTLQPQKQVKENKTQPPVAYQYWPPAELQYRPPPESQYGYPGMPPAPQGRAPYPQPPTRRLNPTAPPSRQGSKLHEIIDKSRKEGDTEAWQFPVTLEPMPPGEGAQEGEPPTVEARYKSFSIKKLKDMKEGVKQYGPNSPYMRTLLDSIAHGHRLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKARKVIVELMAYENANPECQSAIKPLKGKVPAGSDVISEYVKACDGIGGAMHKAMLMAQAITGVVLGGQVRTFGRKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNCPPPQAAVQQVDLCTIQAVSLLPGEPPQKTPTGVYGPLPKGTVGLILGRSSLNLKGVQIHTSVVDSDYKGEIQLVISSSIPWSASPRDRIAQLLLLPYIKGGNSEIKRIGGLGSTDPTGKAAYWASQVSENRPVCKAIIQGKQFEGLVDTGADVSIIALNQWPKNWPKQKAVTGLVGIGTASEVYQSTEILHCLGPDNQESTVQPMITSIPLNLWGRDLLQQWGAEITMPAPSYSPTSQKIMTKMGYIPGKGLGKNEDGIKIPVEAKINQEREGIGNPCLGAATVEPPKPIPLTWKTEKPVWVNQWPLPKQKLEALHLLANEQLEKGHIEPSFSPWNSPVFVIQKKSGKWRMLTDLRAVNAVIQPMGPLQPGLPSPAMIPKDWPLIIIDLKDCFFTIPLAEQDCEKFAFTIPAINNKEPATRFQWKVLPQGMLNSPTICQTFVGRALQPVREKFSDCYIIHCIDDILCAAETKDKLIDCYTFLQAEVANAGLAIASDKIQTSTPFHYLGMQIENRKIKPQKIEIRKDTLKTLNDFQKLLGDINWIRPTLGIPTYAMSNLFSILRGDSDLNSKRMLTPEATKEIKLVEEKIQSAQINRIDPLAPLQLLIFATAHSPTGIIIQNTDLVEWSFLPHSTVKTFTLYLDQIATLIGQTRLRIIKLCGNDPDKIVVPLTKEQVRQAFINSGAWKIGLANFVGIIDNHYPKTKIFQFLKLTTWILPKITRREPLENALTVFTDGSSNGKAAYTGPKERVIKTPYQSAQRAELVAVITVLQDFDQPINIISDSAYVVQATRDVETALIKYSMDDQLNQLFNLLQQTVRKRNFPFYITHIRAHTNLPGPLTKANEQADLLVSSALIKAQELHALTHVNAAGLKNKFDVTWKQAKDIVQHCTQCQVLHLPTQEAGVNPRGLCPNALWQMDVTHVPSFGRLSYVHVTVDTYSHFIWATCQTGESTSHVKKHLLSCFAVMGVPEKIKTDNGPGYCSKAFQKFLSQWKISHTTGIPYNSQGQAIVERTNRTLKTQLVKQKEGGDSKECTTPQMQLNLALYTLNFLNIYRNQTTTSAEQHLTGKKNSPHEGKLIWWKDNKNKTWEIGKVITWGRGFACVSPGENQLPVWIPTRHLKFYNEPIRDAKKSTSAETETSQSSTVDSQDEQNGDVRRTDEVAIHQEGRAANLGTTKEADAVSYKISREHKGDTNPREYAACSLDDCINGGKSPYACRSSCS

SEQ ID NO: 28692 - protein, 394 aa, Homo sapiens
MAVPPSAPQQRASFHLRRHTPCPQCSWGMEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALGPSCVSSTMTASLQCCRVGNRHGEIARLTLSGLFPGVSLLLGSLGPHPEPVLHHRL

SEQ ID NO: 28693 - protein, 135 aa, Homo sapiens
  VARIANT 33: Xaa = Any Amino Acid
MATVQQLEGRWRLVDNKGFDEYMKELGVGIALXKMGAMAKPDCIITCDSKNLTIKTESTLKTTQFSGTLGEKFEENTADGRRTQTVCNFTDGALVQHQEWDGKESTITRKLKDGKLVVERVMNHVACTRIYEKAQ

SEQ ID NO: 28694 - protein, 120 aa, Homo sapiens
MSERLRPRKRRRNGNEEDNHLPPQTKRSSRNPVFQDSWDTESSGSDSGGSSSSSSSSINSPDRASGPEGSLSQTMAGSSPNTPQPVPEQSALCQGLYFHINQTLREAHFHSLQHRGRPLT

SEQ ID NO: 28695 - protein, 123 aa, Homo sapiens
MEPEAFEICPYDPHHRIPLSRFQYHLASCRRKNPKKAKKMATCKYNACHVVPIKNLEEHEAVCVNRSAVEEEDTENPLKVSPPSSEQNDDTQQTFFPQKVVCENDTKESARETSPQKILRPGQ

SEQ ID NO: 28696 - protein, 148 aa, Homo sapiens
MEPEAFEICPYDPHHRIPLSRFQYHLASCRRKNPKKAKKMATCKYNACHVVPIKNLEEHEAVCVNRSAVEEEDTENPLKVSPPSSEQNDDTQQVSPCLPSPDIWNVDGANCQHVFVLKTFFPQKVVCENDTKESARETSPQKILRPGQ

SEQ ID NO: 28697 - protein, 71 aa, Homo sapiens
MVFGIKMTTLQPRIKAPQELTVLQERSRPTSKKMAVCFHGSSLRSEATPRYSLEEEAGNGRWQQALSWWPL

SEQ ID NO: 28698 - protein, 605 aa, Homo sapiens
MSNESCLPYYTAHSYSSMSAFKTSMGDLQRQLYNRGEYNIFKYAPMFESNFIQINKKGEVIDVHNRVRMVTVGIVCTSPILPLPDVMVLAQPTKICEQHVRWGRFAKGRGRRPVKTLELTRLLPLKFVKISIHDHEKQQLRLKLATGRTFYLQLCPSSDTREDLFCYWEKLVYLLRPPVESYCSTPTLLSGDAPPEDNKSLVAAELHREGDQSETGLYKPCDVSAATSSAYAGGEGIQHASHGTASAASPSTSTPGAAEGGAARTAGGMAVAGTATGPRTDVAIAGAAMSPATGAMSIATTKSAGPGQVTTALAGAAIKNPGENESSKSMAGAANISSEGISLALVGAASTSLEGTSTSMAGAASLSQDSSLSAAFAGSITTSKCAAERTEGPAVGPLISTLQSEGYMSERDGSQKVSQPSAEVWNENKERREKKDRHPSRKSSHHRKAGESHRRRAGDKNQKASSHRSASGHKNTRDDKKEKGYSNVRGKRHGSSRKSSTHSSTKKESRTTQELGKNQSASSTGALQKKASKISSFLRSLRATPGSKTRVTSHDREVDIVAKTVEKQNIEAKVEKAQGGQELEMISGTMTSEKTEMIVFETKSI

SEQ ID NO: 28699 - protein, 332 aa, Homo sapiens
MDLFTDGDIFQDIVDAACKRRVPVYIILDEAGVKYFLEMCQDLQLTDFRIRNIRVRSVTGVGFYMPMGRIKGTLSSRFLMVDGDKVATGSYRFTWSSSHVDRNLLLLLTGQNVEPFDTEFRELYAISEEVDLYRQLSLAGRVGLHYSSTVARKLINPKYALVSGCRHPPGEMMRWAARQQWEAGGNPEGQEEGASGGESAWRLESFLKDLVTVEQVLPPVEPIPLGELSQKDGRMVSHMHRDLKPKSREAPSRNGMGEAARGEAAPARRFSSRLFSRRAKRPAAPNGMASSVSTETSEVEFLTGKRPNENSSADISGKTSPSSAKPSNCVIS

SEQ ID NO: 28700 - protein, 413 aa, Homo sapiens
MAEGPEEARGHPPGQDDGGGDHEPVPSLRGPPTTAVPCPRDDPQAEPQAPGRPTAPGLAAAAAADKLEPPRELRKRGEAASGSGAELQEQAGCEAPEAAAPRERPARLSAREYSRQVHEWLWQSYCGYLTWHSGLAAFPAYCSPQPSPQSFPSGGAAVPQAAAPPPPQLGYYNPFYFLSPGAAGPDPRTAAGISTPAPVAGLGPRAPHVQASVRATPVTRVGSAAPSRSPSETGRQAGREYVIPSLAHRFMAEMVDFFILFFIKATIVLSIMHLSGIKDISKFAMHYIIEEIDEDTSMEDLQKMMVVALIYRLLVCFYEIICIWGAGGATPGKFLLGLRVVTCDTSVLIAPSRVLVIPSSNVSITTSTIRALIKNFSIASFFPAFITLLFFQHNRTAYDIVAGTIVVKRNGVR

SEQ ID NO: 28701 - protein, 735 aa, Homo sapiens
MTPELMIKACSFYTGHLVKTHFCTWRDIARTNENVVLAEKMNRAVTCYNFRLQKSVFHHWHSYMEDQKEKLKNMLLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIRFEGNKRVTDASFKFIDKNYPNLSHIYMADCKGITDSSLRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEGLNVLSRHKKLKELSVSECYRITDDGIQAFCKSSLILEHLDVSYCSQLSDMIIKALAIYCINLTSLSIAGCPKITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 28702 - protein, 1094 aa, Homo sapiens
MSYEVTSGCHWTCQVPESCDNGLHCAGPLGHLHRRCQRTSAHLLVFTEHAEMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 28703 - protein, 1043 aa, Homo sapiens
MRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 28704 - protein, 291 aa, Homo sapiens
MEKYSIMKSMNMHRKKGKRTILEMTQILKRHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 28705 - protein, 358 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDSGHPCTAADPDSCFTPVSPQHFIDLFKF

SEQ ID NO: 28706 - protein, 367 aa, Homo sapiens
MPFLGQDWRSPGWSWIKTEDGWKRCESCSQKLERENNRCNISHSIILNSEDGEIFNNEEHEYASKKRKKDHFRNDTNTQSFYREKWIYVHKESTKERHGYCTLGEAFNRLDFSSAIQDIRRFNYVVKLLQLIAKSQLTSLSGVAQKNYFNILDKIVQKVLDDHHNPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLWKKLCQYHFAEKQFCRHLILSEKGHIEWKLMYFALQKHYPAKEQYGDTLHFCRHCSILFWKDYHLALLFKDSGHPCTAADPDSCFTPVSPQHFIDLFKF

SEQ ID NO: 28707 - protein, 466 aa, Homo sapiens
MSFKDKDERISCLEAYVTLTSKSSRFTDETEILKMSQRHSGQAGTEAGNGADSPPIVNSKYSTFRDFCSTSSFQDSGYNELKSCSLDNIDKEYLGKKEKGPTLLYEHPETSGLGLTHPLESPTQKKKCILPRKEKDKTPELCETPKISGKKCLPRRRLNVSFALLKGDFESQNSSLESSISQVINLEKNIPSSASGFSRANNFSPLVTSTLKTEEVTSCSQKLRLNFSQQKTSTIDDSKDDCSLFEVECISPIQGNNFKDSITHDFSDSSLCINDENACPELLGSSVSGTTCGTDEDIFVTPISNLVANIRFNASQILSPSPEVRGSISTPEDSGFNSLSLEKSEDSLSDQEGSFQELLQKHKGTPKVGDTIRKTRHLGRSRRLSTLREQSSQSETEEEKQIVHPDSEKRAAAASAISEGQLSSDESGDLTFSLKNLSKTPALQLVHELFMKSKRKRLQEIVDMNS

SEQ ID NO: 28708 - protein, 443 aa, Homo sapiens
MARPPGGSGPLLDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 28709 - protein, 522 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 28710 - protein, 627 aa, Homo sapiens
MEGLAGYVYKAASEGKVLTLAALLLNRSESDIRYLLGYVSQQGGQRSTPLIIAARNGHAKVVRLLLEHYRVQTQQTGTVRFDGYVIDGATALWCAAGAGHFEVVKLLVSHGANVNHTTVTNSTPLRAACFDGRLDIVKYLVENNANISIANKYDNTCLMIAAYKGHTDVVRYLLEQRADPNAKAHCGATALHFAAEAGHIDIVKELIKWRAAIVVNGHGMTPLKVAAESCKADVVELLLSHADCDRRSRIEALELLGASFANDRENYDIIKTYHYLYLAMLERFQDGDNILEKEVLPPIHAYGNRTECRNPQELESIRQDRDALHMEGLIVRERILGADNIDVSHPIIYRGAVYADNMEFEQCIKLWLHALHLRQKGNRNTHKDLLRFAQVFSQMIHLNETVKAPDIECVLRCSVLEIEQSMNRVKNISDADVHNAMDNYECNLYTFLYLVCISTKTQCSEEDQCKINKQIYNLIHLDPRTREGFTLLHLAVNSNTPVDDFHTNDVCSFPNALVTKLLLDCGAEVNAVDNEGNSALHIIVQYNRPISDFLTLHSIIISLVEAGAHTDMTNKQNKTPLDKSTTGVSEILLKTQMKMSLKCLAARAVRANDINYQDQIPRTLEEFVGFH

SEQ ID NO: 28711 - protein, 766 aa, Homo sapiens
MEEIKPASASCVSKEKPSKVSDLISRFEGGSSLSNYSDLKKESAVNLNAPRTPGRHGLTTTPQQKLLSQHLPQRQGNDADKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 28712 - protein, 399 aa, Homo sapiens
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKIPRYKGQGKKKTSGQKAGDKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 28713 - protein, 379 aa, Homo sapiens
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 28714 - protein, 662 aa, Homo sapiens
MQELESLLAQQKKALAKSITQEKNRVKEALEEEQTRVQELEERLARQKEVLESSIAHEKRKAKEALESEKRKVQDLENHLTQQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQK

SEQ ID NO: 28715 - protein, 1078 aa, Homo sapiens
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGFSLYLIYLLEHYKKLMSQAQELQIKFNSSQETQQSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKMGASSPCLADRW

SEQ ID NO: 28716 - protein, 1145 aa, Homo sapiens
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGFSLYLIYLLEHYKKLMSQAQELQIKFNSSQETQQSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKMRKLRLRELRGAQVHTAAGKDSWDLTPDPSDPGSPAVCRVGRKCRGARTEKRKRIDTLQLCLQRERQAGPAPPACSLNG

SEQ ID NO: 28717 - protein, 74 aa, Homo sapiens
MQVVSWMRKLRLRELRGAQVHTAAETSICRDGEEQDAELKFPGWNQKSLPKDGPRKRDAEERDLQQVQPEPFAF

SEQ ID NO: 28718 - protein, 1104 aa, Homo sapiens
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGFSLYLIYLLEHYKKLMSQAQELQIKFNSSQETQQSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKVGTRKASLKMDQEREMLRKETSSKSSQSLLHSKPSGKY

SEQ ID NO: 28719 - protein, 662 aa, Homo sapiens
MQELESLLAQQKKALAKSITQEKNRVKEALEEEQTRVQELEERLARQKEVLESSIAHEKRKAKEALESEKRKVQDLENHLTQQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSVEMYQSQVAKLEDDIYKEAEEKALLKEALERMEHQLCQEKRINRAIRQQK

SEQ ID NO: 28720 - protein, 1078 aa, Homo sapiens
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGFSLYLIYLLEHYKKLMSQAQELQIKFNSSQETQQSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSVEMYQSQVAKLEDDIYKEAEEKALLKEALERMEHQLCQEKRINRAIRQQKMGASSPCLADRW

SEQ ID NO: 28721 - protein, 1145 aa, Homo sapiens
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGFSLYLIYLLEHYKKLMSQAQELQIKFNSSQETQQSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSVEMYQSQVAKLEDDIYKEAEEKALLKEALERMEHQLCQEKRINRAIRQQKMRKLRLRELRGAQVHTAAGKDSWDLTPDPSDPGSPAVCRVGRKCRGARTEKRKRIDTLQLCLQRERQAAPAPPACSLNG

SEQ ID NO: 28722 - protein, 74 aa, Homo sapiens; identical to SEQ ID NO: 28717

SEQ ID NO: 28723 - protein, 1104 aa, Homo sapiens
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGFSLYLIYLLEHYKKLMSQAQELQIKFNSSQETQQSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSVEMYQSQVAKLEDDIYKEAEEKALLKEALERMEHQLCQEKRINRAIRQQKVGTRKASLKMDQEREMLRKETSSKSSQSLLHSKPSGKY

SEQ ID NO: 28724 - protein, 327 aa, Homo sapiens
MGGSALNQGVLEGDDAPGQSLYERLSQRMLDISGDRGVLKDVIREGAGDLVAPDASVLVKYYGYLEHLDRPFDSNYFRKTPRLMKLGEDITLWGMELGLLSMQRGELARFLFKPNYAYGTLGSPPLIPPNTTVLFKIELLDFLDCAESDKFCALSAEQQDQFPLQKVLKVAATEREFGNYLFRQNRFYDAKVRYKRALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLASCYRDYVDKEKEMWHRMFAPCGDGSTAGES

SEQ ID NO: 28725 - protein, 849 aa, Homo sapiens
MMEPPKPEPELQRFYHRLLRPLSLFPTRTTSPEPQKRPPQEGRILQSFPLAKLTVASLCSQVAKLLAGSGIAAGVPPEARLRLIKVILDELKCSWREPPAELSLSHKNNQKLRKRLEAYVLLSSEQLFLRYLHLLVTMSTPRGVFTESATLTRLAASLARDCTLFLTSPNVYRGLLADFQALLRAEQASGDVDKLHPVCPAGTFKLCPIPWPHSTGFAQVQCSNLNLNYLIQLSRPPEFLNEPGRMDPVKELKSIPRLKRKKPFHWLPSIGKKREIDISSSQMVSLPSYPVAPTSRASPSPFCPELRRGQSMPSLREGWRLADELGLPPLPSRPLTPLVLATESKPELTGLIVAEDLKQLIKKMKLEGTRYPPLDSGLPPLLGVVTRHPAAGHRLEELEKMLRNLQEEEASGQWDPQPPKSFPLHPQPVTITLKLRNEVVVQAAAVRVSDRNFLDSFHIEGAGALYNHLAGELDPKAIEKMDIDNFVGSTTREVYKELMSHVSSDHLHFDQGPLVEPAADKDWSTFLSSAFLRQEKQPQIINPELVGLYSQRANTLQSNTKKMPSLPSLQATKSWEKWSNKASLMNSWKTTLSVDDYFKYLTNHETDFLHVIFQMHEEEVPVEIVAPARESLEIQHPPPLLEDEEPDFVPGEWDWNTVLEHRLGAGKTPHLGEPHKILSLQKHLEQLWSVLEVPDKDQVDMTIKYSSKARLRQLPSLVNAWERALKPIQLREALLARREWFEGQASNPNRFFKKTNLSSSHFLEENQVRSHLHRKLNLMESSLVSLLEEIELIFGEPVIFKGRPYLDKMKSDKVEMLYWLQQQRRVRHLVSALRDPHQSTLFRSSAASL

SEQ ID NO: 28726 - protein, 343 aa, Homo sapiens
MASAGSTARRAGSGSWHSERGEGRGARPQPTPSGSMQQANKVSLKATWTDAESKQPSQPLPDLADHLSAQATALARPRRPASLTPPRADPSPSKESDQTAIDQTAIGSYYQLFAAAVGNVEWLRFCLNQSLREIPTDDKGFTAIHFAAQWGKIACLQVLVEEYKFPVDLLTNNSQTPLHLVIHRDNTTVALPCIYYLLEKGADLNAQTCNGSTPLHLAARDGLLDCVKVLVQSGANVHAQDAMGYKPIDFCKIWNHRACARFLKDAMWKKDKKDFAREMTKMKMFKSQLTLMEHNYLIEYQGQGCSVHFPFAFSPITPETLLWQDISLLSDCGFLWRRRELSF

SEQ ID NO: 28727 - protein, 311 aa, Homo sapiens
MTGSAADTHRCPHPKGAKGTRSRSSHARPVSLATSGGSEEEDKDGGVLFHVNKSGFPIDSHTWERMWMHVAKVHPKGGEMVGAIRNAAFLAKPSIPQVPNYRLSMTIPDWLQAIQNYMKTLHYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 28728 - protein, 388 aa, Homo sapiens
MLLKEKEDSLMTCQQIYKALQEELTVKEKQEEDIKRRINLAENELEITKTLLNQTREEVLTLKNERELMLISHQKSIEQLQETLRQKLLSDDNWKEKIEAELAKERAQHLVEFEEQALLFKEETKLQLDIEKEKHQDVIQKYKKEQEELQMKISDLITGATRDLRQEVTTLKEKLHKSHTRYTEESNSKEKEIENLKNLVAEFESRLKKEIDSNDSVSENLRKEMEQKSDELKRVMLAQTQLIEQFNQSQEENTFLQETVRRECEERFELTEALSQAREQLLELSKLRGSLPFSPCSLSKGSLTSPAAAVSNHGERSLARLNSEKGIQIPNLRGVSKPTTFPTSDKPKRVRSGVPILPQPHPPRGGASSANETRQRLAAILRRRRSQQ

SEQ ID NO: 28729 - protein, 123 aa, Homo sapiens
MALNNVSLSSGDQRSRVAYRSSHGDLRPRASALAMVSGDGFLVSRPEAIHLGPRQAVRPSVRAESRRVDGGGRSPREPDGRGRSRQARFSPYPIPAVEPDLLRSVLQQRLIALGGVIAARISV

SEQ ID NO: 28730 - protein, 886 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVREPRSQDRRRQQQPLNHRPAGSLAPSPAPTSSGPASSHKLGSCLLPDSFNIPGSSCSLLSSGDKPEAVMVIGKGLLGTGARMPCIKTRLQARPRLGRGSPPTRRGMKGSSGPTSPTPRTRESSELELGSCSATPGLPQARPPRPRSAPAFSPISCSLSDSPSWNCYSRGPLGQPEVCFVPKSPPLTVSPRV

SEQ ID NO: 28731 - protein, 816 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVREPRSQDRRRQQQPLNHRPAGSLAPSPAPTSSGPASSHKLGSCLLPDSFNIPGSSCSLLSSGDKPEAVMVIGKGLLGTGARMPCIKTRLQTCPRRVSARRGPGFPRLGPGWAGAHRRLAEG

SEQ ID NO: 28732 - protein, 406 aa, Homo sapiens
MDQSGMEIPVTLIIKAPNQKYSDQTISCFLNWTVGKLKTHLSNVYPSKPLTKDQRLVYSGRLLPDHLQLKDILRKQDEYHMVHLVCTSRTPPSSPKSSTNRESHEALTSSSNSSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLHQAGWFPFRQEGGHQQAPNNNAEVNNDGQNANNLELEEMERLMDDGLEDESGEDGGEDASAIQRPGLMASAWSFITTFFTSLIPEGPPQVAN

SEQ ID NO: 28733 - protein, 778 aa, Homo sapiens
MSKRKLIPKLSIQSPVLHTNLNVQSTHPPLKKEDLHRISKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQISYPVRVTDKTSIQNAKEMENAAIDPEDKWHQRAQQLKNYQEHWSQYESTKSSNVPRGQPSDMVNDHQPSRRPAKLKIRKQCKHQNGLKSSTTEEVTASQGNQNNPPRQQQNQNKPLDTSTKPESIVIMHASNNDVQASRALRSHNLKETSNTFAPPKQAFDKVLSKNSTGCDSGLNVNKERGHKDQEEKRFSYQQLHTLSDMDLNNLNELSKRHVLLSQKGSQFVYHINTHGSTKNKKQLKQPYTETKYRNLEMLWKFHSSSDSQTVRASPDSWLTQIMEQHQQALVQLTDVQPSEGALSSVTLPPILSRVESESQLSSERSQRNQVKISRSNSEGYLFQLEKGKKHKKRSSSKNTKLKGYQKRDVKLGGLGPDFESIRDKTQKLIQQKEYAKQVKEYNMKTLSILSKPQTEKTQKKSAIPRQKALEYAKTIPKPKPSNLTHQASKEQKNPTYAGKEESLPEISLLEILQNRHEREKQAVAAFKVLHIV

SEQ ID NO: 28734 - protein, 307 aa, Homo sapiens
MSKRKLIPKLSIQSPVLHTNLNVQSTHPPLKKEDLHRISKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQVILRVNSLPRDGFKTFWSQ

SEQ ID NO: 28735 - protein, 180 aa, Homo sapiens
MAGVKYPGQDPVDLDIYQSSHMVDYQPYRKHKYSRVTPQEQAKLDAQLRDKEFYRPIPNPNPKLTDGYPAFKRPHMTAKDLGLPGFFPSQEHEATREDERKFTSTCHFTYPASHDLHLAQGDPNQVLQSADFPCLVDPKHQPAAEMAKGYLLLPGCPCLHCHIVKVPILNRWGPLMPFYQ

SEQ ID NO: 28736 - protein, 188 aa, Homo sapiens
MASVSYQKPTSTTVGKQMIFTGPDYIKDYLPKIHQHTSYVGEQHLALEKTGDLRYLWRPASNRSLPAKYKHKYVGEIGWRIPQYNFINKSRLESGFHIKYEELSQASLDSITHRYQNPWQPKPHVLDMQGKQSRASFAWHMSAFEDTDQRNSKWAILVRQCKSSLPRASKPPKLPKLPKRKRKGNINL

SEQ ID NO: 28737 - protein, 81 aa, Homo sapiens
MCSREVTTLQGLGTTSASEESLTDDHRLLKVISQGSFAEVKAAGPAHSHWDQDGCGGHPNRAAGLLQPPGSVLQGPYDEGP

SEQ ID NO: 28738 - protein, 387 aa, Homo sapiens
MVCGIQEAAENYRKLFQEILNTSREKLEAAKSILTDEQERMAMIQEEEQNFKKMIESEYSMRLRLLNEECEQNLQRQQECISDLNLRETLLNQAIKLATELEEMFQEMLQRLGRVGRENMEKLKESEARASEQVRSLLKLIVELEKKCGEGTLALLKNAKYSLERSKSLLLEHLEPAHITDLSLCHIRGLSSMFRVLQRHLTLDPETAHPCLALSEDLRTMRLRHGQQDGAGNPERLDFSAMVLAAESFTSGRHYWEVDVEKATRWQVGIYHGSADAKGSTARASGEKVLLTGSVMGTEWTLWVFPPLKRLFLEKKLDTVGVFLDCEHGQISFYNVTEMSLIYNFSHCAFQGALRPVFSLCIPNGDTSPDSLTILQHGPSCDATVSP

SEQ ID NO: 28739 - protein, 127 aa, Homo sapiens
MGNLCGCIQGDSKKPSKKRVKRKPYSTTKVTSGSTFNENTRRYAVHTNQCRRPHGSRVKKKRYPQEDDFHHTVFSNLERLDKLQPTLEASEESLVHKDRGDGERPVNVKVVQVAPLRRESRAIDTGE

SEQ ID NO: 28740 - protein, 68 aa, Homo sapiens
MGNLCGCIQGDSKKPSKKRVKRKPYSTTKVTSGSTFNGTYSGITHWLLEKDSTGNLELNCWLLSGEPP

SEQ ID NO: 28741 - protein, 68 aa, Homo sapiens; identical to SEQ ID NO: 28740

SEQ ID NO: 28742 - protein, 127 aa, Homo sapiens
MTTNLDLKVSMLSFISATCLLLCLNLFVAQVHWHTRDAMESDLLWTYYLNWCSDIFYMFAGIISLLNYLTSRSPACDENVTVIPTERSRLGVGPVTTVSPAKDEGPRSEMESLSVREKNLPKSGLWW

SEQ ID NO: 28743 - protein, 127 aa, Homo sapiens; identical to SEQ ID NO: 28742

SEQ ID NO: 28744 - protein, 640 aa, Homo sapiens
MEATEPQDMVVYDQSTRDASVLAADRFLSILLSKLDSCFDSVAILTGGFATFSSCFPSLCQGKPAALLPMSLSQPCLPVPSVSLTLILPHLYLGSQKDVLNKDLTTQNGISYVLNASNSTFEACDPQRTGTVAVAQVLAYLEAVTGQGPQDARLQTLANSLDPNGEGPKATVDLDTFLVVMRDWIAACQLHGGLELEEETAFQGALTSQQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPDELPEGAQLRRVGWTELLPPSLGLEIEAIRQEVATADLSNPLCGVWQWEEVIHETSEETEFPSEAPAGGQRNFQGEPAHPEEGRKEPSMWLTRREEEEDAESQVTADLPVPLGAPRPGDIPENPPERPARRELQQALVPVMKKLVPVRRRAWGQLCLPPQRLRVTRHPLIPAPVLGLLLLLLLSVLLLGPSPPPTWPHLQLCYLQPPPV

SEQ ID NO: 28745 - protein, 283 aa, Homo sapiens
MEWKLEQSMREQALLKAQLTQLKESLKEVQLERDEYAEHLKGERARWQQRMRKMSQEVCSLKKEKKHDKYRVEKLERSLSKLKHQMAEPLPPEPPAVPSEVELQHLRKELERVAGELQAQVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 28746 - protein, 132 aa, Homo sapiens
MKPRPISLVPESLADSCISINLLSQMFSSDLSSYPSFSKSLLATLLASCYTLQSSSSQSPDFFLKVAYYIYISLLLNIPQLFPSGHRIKSSFLACYLGSFSASPHKFLTHLAEAPSFQYSPKCCGTSVYAGF

SEQ ID NO: 28747 - protein, 160 aa, Homo sapiens
MLPEMKRESRMAEESPAQETPRLGQSSSRRGQGLSVYYSKQASPRDVVWEGPKPTRQAHPVGKRLPIPVWPASLTSASQSSADLRGAGWPLLIWVREMPETHPGLNHRLVVQSHSPCAFRKPRGPKYEWEESWEKLNQTLPMAIKEKIQQRLPLSLTLRS

SEQ ID NO: 28748 - protein, 791 aa, Homo sapiens
MSNRQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATVKVVLIPVGQEIVIPFKVDTILKYLKDHFSHLLGIPHSVLQIRYSGKILKNNETLVQHGVKPQEIVQVEIFSTNPDLYPVRRIDGLTDVSQIITVTVQTGLDQYQQVPVEIVKSDFHKPSLGGFRHKVTGVEYHNAGTQTVPKRIPERLSIFCRDTQTVFQKKNLQQTTNTTSTQMTNIGVYVSNMTDKLVTPGKYFSAAEYHAQRLKAVTVIQTYYRQWHAKIFVENLRRQKSLRLEWETQQELRKIREKEEWIKLDYHRRHNPKTNEDFEFLYNALEFWRQEELTRINQSFTGAERKAALCELLEKETQIIASIGRHRYIAYMANQEAAIQAFLDKCSAPKIWRTPNGKTIEMDTQFTIRARELQNIYKCIMLKNISQDERLDVLLTLKHTVKEHECKLTQEILELIDREVDLMMRGVKHHNLEGLRKRIATLFFHYIKTPLFNPEVAKYLKVPQDPLKFYKKIYFCHSCQLYLPSTEFSVSSTSRRIYRCRNCINLQNEAQKRESFLKYKCLLQQLYYTEADYEDDSKIAFLMQLQDIQYLTENIWASQSVLSACDNLSDLVMVRWNKSLEWSPWNCILLTKDEAAAHLKLTSIEEGYERSFIHKIKHKHILAKNYFSQVPVLASFILDDGEIDEIRWKYHSDTTPKIIESQRPPH

SEQ ID NO: 28749 - protein, 622 aa, Homo sapiens
MEKQYLRNSNLTPQQKIDELHHGFTGLDLEEQWMYPSRSDHSNCHNIQTNDTAKTTFQEYPLIKNCFTPQTGLSDIMKESGVDIYHYGRDRICTKGLEAPLQQKRAEMFLSQFNRYTENVDYCRYPEYVHPNKAKLNKCSNFSVQDSKKLANGTPETPTVEADTYTKLFQVKPANQKKMEETIPDQQNFTFPKTTPHLTEKQFAKEAVFTADFGLTSEYGLKPHTACPANDFANVTEKQQFAKPDPPHSEYFKSVNLLSNSATSSGGINLNRPTWMNVQTKNNTPIPYRNQGNLMKLNSHLSAASKGSNHSSDFPQLSSTNLTPNSNLFQKYCQENPSAFSSFDFSYSGAERIQSVNHIEGLTKPGEENLFKLVTDKKIKQPNGFCDNYSAQKYGIIENVNKHNFQAKPQSGHYDPEEGPKHLDGLSQNTYQDLLESQGHSNSHRTRGGDNSRVNRTQVSCFSNNYMMGDLRHNQCFQQLGSNGFPLRSTHPFGHSVVPLLDSYDLLSYDDLSHLYPYFNMMYGDNSFSGLMPTFGFQRPIKTRSGPASELHIRLEECCEQWRALEKERKKTELALAKNYPGKKVSSTNNTPVPRLTSNPSRVDRLIVDELRELARVSCKNR

SEQ ID NO: 28750 - protein, 650 aa, Homo sapiens
MWPQPHLPPHPMMSEKTRQNKLAEAKKKFTDYRQWNIAGVGTGATDTKKKKINHGTNPETTTSGGCHSPEDTQQNRAQLKEEKKASHQHQEALRREIEAQDHTIRILTCQKTELETALYYSQDAARKFEDGNLGTPSSFNLALSQAFRGSPLGCVSTSLIPGESKDLAGRLHHSWHFAGELQRALSAVSTRHKKADRYIEELTKERDALSLELYRNTITNEELKKKNAELQEKLPLAESEKSEIQLNVKELKRKLERAKFLLPQVQTNTLQEEMWRQEEELREQEKKIRKQEEKMWRQEERLREQEGKMREQEEKMWRQEKRLREQEKELREQEKELREQKKLREQEEQMQEQEEKMWEQEEKMREQEEKMWRQEERLWEQEKQMREQEQKMRDQEERMWEQDERLREKEERMREQEKMWEQVEKMREEKKMQEQEKKTRDQEEKMQEEERIREREKKMREEEETMREQEEKMQKQEENMWEQEEKEWQQQRLPEQKEKLWEQEKMQEQEEKIWEQEEKIRDQEEMWGQEKKMWQEEKMWGQEEMMREKEERIRDQKEKMQERLPEHEERCSEPCLPPSKVLCNMSHTGSVEPAGGEAGEGSPQDNPTAQEIMQLFCGMKNAQQCPGLGSTSCIPFFYRGDKRKMKIINI

SEQ ID NO: 28751 - protein, 1692 aa, Homo sapiens
MRRPPPLGPTTASGPEGNVRNLQKRQAPGPGAAGGCGPEAGGCRENKQKRRMVARATPGRGEVESDKSVAASGAGKAARRQVEGRRGPVSPSDSSDPRGLEAAKEAELPLQTERHTKEKRKVTEASSDDPQPGLDLVRKESLTSSESFQTVECLQSLGKESIIEGIKRRIRNKKLKSLENPPLKITENEATQNIKVEFQDELYKNTPKYSCNILSPEVENNSVLKLRDCNCFPHSKGCNDENNLPYKPDGGCMHVAENFSKKENLRSLAEKSDTNSIPQLLQTEENVMGVNKLLPEESDLYQSKTNGLLSCLQHEKNKYSIEESSVGRKPRKRMKLSEKADETVTEMNFSNEYNKSELMLQENQMIADGKEAETKSPLNVLRKVSHNTVSLMDHLLSVPETVEKETSSEHHVNAVFQKTIEPLLKEETENASEPLGYESMASKEDFKSMKSFIGKSPNEYHIERRSSREDLRSASEELKLSCQRTIPMTGKRTWPYYSCARISAWCWKKASLPESSYFLRGSQESCRQVDVPKHQTNQTHLTDSKLLLQSSLTETNTESSSKEKLDSNSNCLSSVSAVEPTLMVIKEPIIKDDKKIKSEELSRRGSEVISNTTEDTQLTSETQSLTGNKKKARGNLTKLNLTATSKDGQEANNSAGKTIHRKACIAQQTFIVPDLVKILNTGRLTNFKIPLLKNKSEKRKEVNAKSSEREAYSPLELLDNLSGADVRQNRSKENVSMMMLGPQTLSIRNSVTPVQASSDSFYNKKSYSISPSFTKQGNNSKPSNHVSEPGNIVSNKEVASLTVENNAFSCDPGYVEKSPSFCCNEQETFRPVSSEVRGRKITKNFSEVGFPDILKAYEDDVLLIDVIQDDPDLFGVSNEGELSFTSEVPKISQEPNVAGEHQSTDSKYMETPVKKEPSDDLRELPVLDCGWIKPDICASNSAESEIKRDPKDVNTSLGEVANETSENETLGDFSEQIKGSDLDEKHRFTDKVITKEEKENIYEVCKSKDSRNADFMVGECQFAVPVPKPLCLLVPPLNLSGRQEDTILNTWMNDFRFLGKHSVLKLQNPETCEIFKREKNVGVFQKSLGLMIPYKYCKFHFNTLRGCERPLCKFAHVPEQGDEKVCMDVFKKYININELCLLQRAVNIFMEYYRKFPPGVYFDLQVLNDLLNSLLKHCLLKEVFQIVNLSIMVKMLPSLKILLNIFEYVATMKLRNAVPALIDIFCKLVEAGMVLDPEHFNYIVKLLYQVQASKQEITAVLEMKSRLQMRRFKKNWKCDLDSALNKLEHCKEKGDWTKLGKLYINVKMGCEKFADFQTFCACIAETLTKNYEDERPDIPFCEFAETVSKDPQNSKVDKGVLGRIGISAMYFYHKLLQWSKGRKVLEKLYELKIHFTSLKGLIGPEKLASRCQIVNVAAEIFLKSGSLDGAIWVMRESEWIINTPLWPCDRLDVLNRHNLLCTIAHEILAKSLYRQTFEVLQNLPGFQNSQETVEVSQYSLLFNKLLGSCIESSSLGMSSSVAEFMISKSIPIDFSFLRRLITSLGRSRLWLKARAHYKSALSLGCYPPLEGNLYRKLLLIPSYLSEIEMLLAIEIFMVSNASSIQSPGTSTQILQIVLKRCEDNQSRSNDDYQAAVERLIMAARISDPKLFVKHMTVNVNKEQVYSLEHCSALKWLKENMKWAGKVWLFSNH

SEQ ID NO: 28752 - protein, 1692 aa, Homo sapiens
MRRPPPLGPTTASGPEGNVRNLQKRQAPGPGAAGGCGPEAGGRRENKQKRRMVARATPGRGEVESDKSVAASGAGKAARRQVEGRRGQVSPSDSSDPRGLEAAKEAELPLQTERHTKEKRKVTEASSDDPQPGLDLVRKESLTSSESFQTVECLQSLGKESIIEGIKRRIRNKKLKSLENPPLKITENEATQNIKVEFQDELYKNTPKYSCNILSPEVENNSVLKLRDCNCFPHSKGCNDENNLPYKPDGGCMHVAENFSKKENLRSLAEKSDTNSIPQLLQTEENVMGVNKLLPEESDLYQSKTNGLLSCLQHEKNKYSIEESSVGRKPRKRMKLSEKADETVTEMNFSNEYNKSELMLQENQMIADGKEAETKSPLNVLRKVSHNTVSLMDHLLSVPETVEKETSSEHHVNAVFQKTIEPLLKEETENASEPLGYESMASKEDFKSMKSFIGKSPNEYHIERRSSREDLRSASEELKLSCQRTIPMTGKRTWPYYSCARISAWCWKKASLPESSYFLRGSQESCRQVDVPKHQTNQTHLTDSKLLLQSSLTETNTESSSKEKLDSNSNCLSSVSAVEPTLMVIKEPIIKDDKKIKSEELSRRGSEVISNTTEDTQLTSETQSLTGNKKKARGNLTKLNLTATSKDGQEANNSAGKTIHRKACIAQQTFIVPDLVKILNTGRLTNFKIPLLKNKSEKRKEVNAKSSEREAYSPLELLDNLSGADVRQNRSKENVSMMMLGPQTLSIRNSVTPVQASSDSFYNKKSYSISPSFTKQGNNSKPSNHVSEPGNIVSNKEVASLTVENNAFSCDPGYVEKSPSFCCNEQETFRPVSSEVRGRKITKNFSEVGFPDILKAYEDDVLLIDVIQDDPDLFGVSNEGELSFTSEVPKISQEPNVAGEHQSTDSKYMETPVKKEPSDDLRELPVLDCGWIKPDICASNSAESEIKRDPKDVNTSLGEVANETSENETLGDFSEQIKGSDLDEKHRFTDKVITKEEKENIYEVCKSKDSRNADFMVGECQFAVPVPKPLCLLVPPLNLSGRQEDTILNTWMNDFRFLGKHSVLKLQNPETCEIFKREKNVGVFQKSLGLMIPYKYCKFHFNTLRGCERPLCKFAHVPEQGDEKVCMDVFKKYININELCLLQRAVNIFMEYYRKFPPGVYFDLQVLNDLLNSLLKHCLLKEVFQIVNLSIMVKMLPSLKILLNIFEYVATMKLRNAVPALIDIFCKLVEAGMVLDPEHFNYIVKLLYQVQASKQEITAVLEMKSRLQMRRFKKNWKCDLDSALNKLEHCKEKGDWTKLGKLYINVKMGCEKFADFQTFCACIAETLTKNYEDERPDIPFCEFAETVSKDPQNSKVDKGVLGRIGISAMYFYHKLLQWSKGRKVLEKLYELKIHFTSLKGLIGPEKLASRCQIVNVAAEIFLKSGSLDGAIWVMRESEWIINTPLWPCDRLDVLNRHNLLCTIAHEILAKSLYRQTFEVLQNLPGFQNSQETVEVSQYSLLFNKLLGSCIESSSLGMSSSVAEFMISKSIPIDFSFLRRLITSLGRSRLWLKARAHYKSALSLGCYPPLEGNLYRKLLLIPSYLSEIEMLLAIEIFMVSNASSIQSPGTSTQILQIVLKRCEDNQSRSNDDYQAAVERLIMAARISDPKLFVKHMTVNVNKEQVYSLEHCSALKWLKENMKWAGKVWLFSNH

SEQ ID NO: 28753 - protein, 468 aa, Homo sapiens
MSTADLMENLREELTCFICLDYFSSPVTTECGHSFCLVCLLRSWEEHNTPLSCPECWRTLEGPHFQSNERLGRLASIARQLRSQVLQSEDEQGSYGRMPTTAKALSDDEQGGSAFVAQSHGANRVHLSSEAEEHHREKLQEILNLLRVRRKEAQAVLTHEKERVKLCQEETKTCKQVVVSEYMKMHQFLKEEEQLQLQLLEQEEKENMRKLRNNEIKLTQQIRSLSKMIAQIESSSQSSAFESLEEVRGALERSEPLLLQCPEATTTELSLCRITGMKEMLRKFSTEITLDPATANAYLVLSEDLKSVKYGGSRQQLPDNPERFDQSATVLGTQIFTSGRHYWEVEVGNKTEWEVGICKDSVSRKGNLPKPPGDLFSLIGLKIGDDYSLWVSSPLKGQHVREPVCKVGVFLDYESGHIAFYNGTDESLIYSFPQASFQEALRPIFSPCLPNEGTNTDPLTICSLNSHV

SEQ ID NO: 28754 - protein, 725 aa, Homo sapiens
MASWGGEKRGGAEGSPKLAVYATRKTRSVRSQEDQWYLGYPGDQWSSGFSHSWWKNSVGSESKHGEGALDQPQHDVRLEDLGELHRAARSGDVPGVEHVLAPGDTGVDKRDRKKSIQQLVPEYKEKQTPESLPQNNNPDWHPTNLTLSDETCQRSKNLKVGDKSPSVSPSMPENQSATKELGQMNLTEREKMDIGVVLLSGNDTLHDLCQSQLPENKESKEAEQDLELTSEEEQEGLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKLHLHENKLDCDNDNKLGIGHIFSTDNNFHNDASTKKARNPEVVTVEMKEDQEFDLQMTKNMNQNSDSGSTNNYKSLKPKLENLSSLPPDSDRTSEVYLHEELQQDMQKFKNEVNTLEEEFLALKKENVQLHKEVEEEMEKHRSNSTELSGTLTDGTTVGNDDDGLNQQIPRKENEEHDRPADKTANEKNKVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRLALKQENGRKEMPICCIIKIVNS

SEQ ID NO: 28755 - protein, 374 aa, Homo sapiens
MRAPMLQKQQAPRMDTPPPEERLEKQNEKLNNQEEETEFKELDGLREALANLRGLSEEERSEKAMLRSRIEEQSQLICILKRRSDEALERCQILELLNAELEEKMMQEAEKLKAQGEYSRKLEERFMTLAANHELMLRFKDEYKSENIKLREENEKLRLENSSLFSQALKDEEAKVLQLTVRCEALTGELETLKERCAQDACQAQAREKELLELQSQQACTHTKETEQLRSQLQTLKQQHQQAVEQIAKAEETHSSLSQELQARLQTVTREKEELLQLSIERGKVLQNKQAEICQLEEKLEIANEDRKHALERFEQEAVAVDSNLRVRELQRKVDGIQKAYDELRLQSEAFKKHSLDLLSKERELNGKLRHLSP

SEQ ID NO: 28756 - protein, 2439 aa, Homo sapiens
MAQIQKDKANISEKSVMHPEYIAVKAEKSPLSHILKTKELQVNISQQGEKAQEGEVEIVVLLSKTCPFVTSSAFLELDSIKEEEGEPRITRSFMPHLEIQESLPSRQTAPTKPTESLVKKEKQLLPQKEDRVQTVSMHGLMHPNGAVFKAKTSAPPQVFSITEHSPLSKRKEPQWGMKERAGQKQDRTGRPHVILTKTHPFMPSLSHHRFSPSQPKLPISSGAGKSRLANSNEGISSHKVILKANQQMPYKEAKDRVKIEGREGRILPKRIHLRAEALPLALLCNGKNYSLHIEEQGEGVQESKKEPGVVPRKSASFPPPPFYLNCDTRRNEKEGTLGKTQFSFPPLKIQDSSDSGKKAYTESLHGYTLSNSKGPVQPTAQGEEKGGLRIDMEDKMLPKCTDLKAKQLLLSDILNTKKLQWKSKEQKRKIQEDKNKQVKGLPSINTSLLTPPYLKFDTTEGQENVIRIAKVSLPQSRSKESSDAGRIACPEATHGELSSDVKQLKAHLLQKEEKDREKVADMTSVLDPNKMYLKAKKSPVLHTHSFSDLQWKTREQEEEKVQKVKSGPGVMLSKSPSRSSPLHLNVNTGFQEESIPILTRPSFPLVKLQVSPDTEGGTCIRPIAGDILIYLQKGKHVSQNKEEDDVQIVSILIFPKHQEEKVQECEGEPGVVLTKSTSLPSLSQLELDKETHLGNEMLRLKRPILRRISHIGETVHRESVVGDIPKDRNQKKIIDMRGTDITLKSKKSPRSCMLHRTELHVNIGGQGRKEHEGQDKPPGMIQRKMCILFSKPLPSNLKLERATHADEERLGGKTSFVLPLMPSALPDTEKTADAEARSGDVRKGKPHRSQKENRHEVKTIDMRFRIHCQEARISPMSHILNAKELVLNINKLEKKVHKDKDEACVVLSRTFLSIPSAPPLYLDSGNKTDKDTPGITGSSCPQRTLHVPSNTQKITNRDSVEGVDKNVVKQAEQYVPRPEAEQQLTSNFMISVQQRNQPSRVRSEEDLNQLVLNSRDEDIYFTGFGTIRSGKRPEWLFTGKKAQPVKYKTETLTAFLSYPTMDATKMGGLEEDTEIMDNLNHKISPKASVSLIRKISKELYVTLGTPANSKGFSVSERYAHQQETSSKVSPELAGSCKFDKPKEDGQSNDRISKMFSPKVLAPQTKGSLKKISIVTNWNAPQNIEEQDIVMKKQVIRRCEHGHKTRTNTILSKFPLQSGKQKTPSETDVDKKTTAHLSLQMLPGIHMDMTEIDPAKGGRKQALLISEQEEGVLEFLPKSLFPPWTFQFQSGDLEEKHQTDANTNINLEQKKLEMDNDSTVNQKEGKLKIGTNRALHLQEEKTEMHKARTANLEKERGRMDTSSSAHPHLLSLKAEESQMKTQVITHRENSRLIMQKQKKELEASNAKQSIQLQKLFQRNVLDSFYSYVPLSPKRKDQKGRLTIRDLKRELSTKYLTMKIQNHPIPQMLNITGRGTPSNRKKLEYDVKLKNIASWSKDVSGIFIRSLSISIMRSPHTDPKTNLEREKRICLPKFQEKSPNTSEMSKRDTLTIVKGEQNFTNTVPQDPQPFAVDKQQMQKLPNVKSEANLRSEMNKKYLKAQTKERIVPEHDVSRIIKKPDLRIIEQEEKILKRILTPTECPSMLEDPKLPKQRDQSEPVWDMTTQKVQQQKAFPGTVPIPPQVKSSEVKIVADSTNAEHLLPICEATKAISESQVKNMIQDKVSSDKLDNIQAYKPDDLKSPPFPEGPDTISTAIYPKTQHKSLLEQFTPKEKNKLTSHLESKALEIQLNLIPEMARKSLQMFNFYPKGTISKDNSWRFYSRHKTMNFMSLEGTDTIEPNSKHKHQKDSPLASNMKTLIVDVSSDSEETITKLQSINKLENGTSAVTSASEMLLPHTLQNHSVKEKGKLLMHFSVKTLEIQMKAFPRIVRESYAMTSAHERKKPLSNCIHPGFTGPKRQNRILLLSEEKSLHQIDLDLQYKYLRFLLGLPVGSTFPKPNVLPKHSKLNTIAVCKNVNAGGQSGSLSIDTELLEQHISFKKQSPHENSSLIRKFPQPTLVCASDRDLHSPRKKDTQVLSESEFHVTPEKNKQYHVWFQERNTCESVDLRTQRNATGSAVSCETQISEDFVDIQTDIESPADLDECSCLEVSESEECVFLEANSYLSQESENILFELQTGIPLENVYKITTDLKSFYSEDSGSHCTRECRKETLIITPPSCKSHKSRKYRSSSKMKSPDWLCHSSSNTAEIQSRSSSVSFSEEKISWTTKSRTSYSSAPLTESNIKSHLAKNQGKSHRHPESQERKKARSDLFRKNSSHWDHDYSCTHSKGKRDRKKRVYDYESERLDCFQSKHKSASKPHHDDINFYSERKQNRPFFFACVPADSLEVIPKTIRWTIPPETLRKRNFRIPLVAKISSSWNIWSSSKKLLGSLSGSLTTVFHS

SEQ ID NO: 28757 - protein, 2439 aa, Homo sapiens
MAQIQKDKANISEKSVMHPEYIAVKAEKSPLSHILKTKELQVNISQQGEKAQEGEVEIVVLLSKTCPFVTSSAFLELDSIKEEEGEPRITRSFMPHLEIQESLPSRQTAPTKPTESLVKKEKQLLPQKEDRVQTVSMHGLMHPNGAVFKAKTSAPPQVFSITEHSPLSKRKEPQWGMKERAGQKQDRTGRPHVILTKTHPFMPSLSHHRFSPSQPKLPISSGAGKSRLANSNEGISSHKVILKANQQMPYKEAKDRVKIEGREGRILPKRIHLRAEALPLALLCNGKNYSLHIEEQGEGVQESKKEPGVVPRKPASFPPPPFYLNCDTRRNEKEGTLGKTQFSFPPLKIQDSSDSGKKAYTESLHGYTLSNSKGPVQPTAQGEEKGGLRIDMEDKMLPKCTDLKAKQLLLSDILNTKKLQWKSKEQKRKIQEDKNKQVKGLPSINTSLLTPPYLKFDTTEGQENVIRIAKVSLPQSRSKESSDAGRIACPEATHGELSSDVKQLKAHLLQKEEKDREKVADMTSVLDPNKMYLKAKKSPVLHTHSFSDLQWKTREQEEEKVQKVKSGPGVMLSKSPSRSSPLHLNVNTGFQEESIPILTRPSFPLVKLQVSPDTEGGTCIRPIAGDILIYLQKGKHVSQNKEEDDVQIVSILIFPKHQEEKVQECEGEPGVVLTKSTSLPSLSQLELDKETHLGNEMLRLKRPILRRISHIGETVHRESVVGDIPKDRNQKKIIDMRGTDITLKSKKSPRSCMLHRTELHVNIGGQGRKEHEGQDKPPGMIQRKMCILFSKPLPSNLKLERATHADEERLGGKTSFVLPLMPSALPDTEKTADAEARSGDVRKGKPHRSQKENRHEVKTIDMRFRIHCQEARISPMSHILNAKELVLNINKLEKKVHKDKDEACVVLSRTFLSIPSAPPLYLDSGNKTDKDTPGITGSSCPQRTLHVPSNTQKITNRDSVEGVDKNVVKQAEQYVPRPEAEQQLTSNFMISVQQRNQPSRVTSEEDLNQLVLNSRDEDIYFTGFGTIRSGKRPEWLFTGKKAQPVKYKTETLTAFLSYPTMDATKMGGLEEDTEIMDNLNHKISPKASVSLIRKISKELYVTLGTPASSKGFSVSERYAHQQETSSKVSPELAGSCKFDKPKEDGQSNDRISKMFSPKVLAPQTKGSLKKISIVTNWNAPQNIEEQDIVMKKQVIRRCEHGHKTRTNTILSKFPLQSGKQKTPSETDVDKKTTAHLSLQMLPGIHMDMTEIDPAKGGRKQALLISEQEEGVLEFLPKSLFPPWTFQFQSGDLEEKHQTDANTNINLEQKKLEMDNDSTVNQKEGKLKIGTNRALHLQEEKTEMHKARTANLEKERGRMDTSSSAHPHLLSLKAEESQMKTQVITHRENSRLIMQKQKKELEASNAKQSIQLQKLFQRNVLDSFYSYVPLSPKRKDQKGRLTIRDLKRELSTKYLTMKIQNHPIPQMLNITGRGTPSNRKKLEYDVKLKNIASWSKDVSGIFIRSLSISIMRSPHTDPKTNLEREKRICLPKFQEKSPNTSEMSKRDTLTIVKGEQNFTNTVPQDPQPFAVDKQQMQKLPNVKSEANLRSEMNKKYLKAQTKERIVPEHDVSRIIKKPDLRIIEQEEKILKRILTPTECPSMLEDPKLPKQRDQSEPVWDMTTQKVQQQKAFPGTVPIPPQVKSSEVKIVADSTNAEHLLPICEATKAISESQVKNMIQDKVSSDKLDNIQAYKPDDLKSPPFPEGPDTISTAIYPKTQHKSLLEQFTPKEKNKLTSHLESKALEIQLNLIPEMARKSLQMFNFYPKGTISKDNSWRFYSRHKTMNFMSLEGTDTIEPNSKHKHQKDSPLASNMKTLIVDVSSDSEETITKLQSINKLENGTSAVTSASEMLLPHTLQNHSVKEKGKLLMHFSVKTLEIQMKAFPRIVRESYAMTSAHERKKPLSNCIHPGFTGPKRQNRILLLSEEKSLHQIDLDLQYKYLRFLLGLPVGSTFPKPNVLPKHSKLNTIAVCKNVNAGGQSGSLSIDTELLEQHISFKKQSPHENSSLIRKFPQPTLVCASDRDLHSPRKKDTQVLSESEFHVTPEKNKQYHVWFQERNTCESVDLRTQRNATGSAVSCETQISEDFVDIQTDIESPADLDECSCLEVSESEECVFLEANSYLSQESENILFELQTGIPLENVYKITTDLKSFYSEDSGSHCTRECRKETLIITPPSCKSHKSRKYRSSSKMKSPDWLCHSSSNTAEIQSRSSSVSFSEEKISWTTKSRTSYSSAPLTESNIKSHLAKNQGKSHRHPESQERKKARSDLFRKNSSHWDHDYSCTHSKGKRDRKKRVYDYESERLDCFQSKHKSASKPHHDDINFYSERKQNRPFFFACVPADSLEVIPKTIRWTIPPETLRKRNFRIPLVAKISSSWNIWSSSKKLLGSLSGSLTTVFHS

SEQ ID NO: 28758 - protein, 131 aa, Homo sapiens
MNLRGWILLTHLGYQGQTKDMESRPRRRYQASSFTDAPVMTMTASLLPLVPDSVSAVTRHQAGSKEPSLSPAPTNSYGAPFPRLGLLSTQFLITYHEKLSPWQLSPSGEIYNCTATTACGMVKLHQDLCCP

SEQ ID NO: 28759 - protein, 1585 aa, Homo sapiens
MTLSTEESIEVFGDINLTLGMLNKEDIVNKEDIYSHLTSVIQNTDILDDAIVQRLIYYASKDMRDNNMLREIRMLAGEVLVSLAAHDFNSVMYEVQSNFRILELPDEFVVLALAELATSYVSQSIPFMMMTLLTMQTMLRLAEDERMKGTFCIALEKFSKAIYKYVNHWRDFPYPRLDANRLSDKIFMLFRYIMEKWAPLASPMQTLSIVKAHGPTVSLLLHREDFRGYALGQVPWLLNQYKDKEIDFHVTQSLKQILTAAVLYDIGLPRSLRRSIFINLLQQICRAPEPPVKENEMKASSCFLILAHSNPGELMEFFDEQVRSNNEAIRVGILTLLRLAVNADEPRLRDHIISIERTVKIVMGDLSTKVRNSVLLLIQTMCEKSYIEAREGWPLIDYVFSQFATLNRNLEKPVKTNFHENEKEEESVRETSLEVLKTLDPLVIGMPQVLWPRILTFVVPAEYTEALEPLFSIIRILIMAEEKKQHSAKESTALVISTGAVKLPSPQQLLARLLVISMPASLGELHGAGAIGLLKILPEIIHPKLVDLWKTRLPELLQPLEGKNISTVLWETMLLQLLKESLWKISDVAWTIQLTQDFKQQMGSYSNNSTEKKFLWNALGTTLACCQDSDFVNSQIKEFLTAPNQLGDQRQGITSILGYCAENHLDIVLKVLKTFQNQEKFFMNRCKSLFSGKKSLTKTDVMVIYGAVALHAPKKQLLSRLNQDIISQVLSLHGQCSQVLGMSVMNKDMDLQMSFTRSITEIGIAVQDAEDQGFQFSYKEMLIGYMLDFIRDEPLDSLASPIRWKALIAIRYLSKLKPQLSLQDHLNILEENIRRLLPLPPLENLKSEGQTDKDKEHIQFLYERSMDALGKLLKTMMWDNVNAEDCQEMFNLLQMWLVSQKEWERERAFQITAKVLTNDIEAPENFKIGSLLGLLAPHSCDTLPTIRQAAASSTIGLFYIKGIHLEVERLQGLQEGLESDDVQVQIKISSKIAKIVSKFIPNEEILMFLEEMLDGLESLNPTCTKACGIWMITVLKQQGAALEDQLLEILGTIYHHMPVLRQKEESFQFILEAISQIASFHMDTVVVNLLQKPLPFDRDTKTLWKALAEKPASSGKLLQALIDKLETELEDDIARVEAISVACAMYEVISMGTSVTGLYPELFTLLLKLVSCTLGQKMPTCPWSHRRHVMQQGEQQQIPDPCRLSTATLKCLQAQAMREGLAKESDEGDNLWTLLSSPSTHHIGVCSLARSMAVWQHGVILDIMEQLLSSLTSSSENYRITGAAFFSELMKEPILWKHGNLRNVLILMDQSAWDSNATLRQMAIRGLGNTASGAPHKVKKHKQLMLESIIRGLYHLARTEVVCESLKALKKILELLTDRDVSFYFKEIVLQTRTFFEDEQDDVRLTAIFLFEDLAPLTGRRWKIFFAEEIKKSLISFLLHLWDPNPKIGVACRDVLMVCIPFLGLQELYGVLDRLLDQDLPRARDFYRQFCVKLAKKNQEILWILHTHSFTFFTSTWEVIRSAAVKLTDAVVLNLTSQYVELLDREQLTTRLQALRQDPCISVQRAAEAALQTLLRRCKETSIPL

SEQ ID NO: 28760 - protein, 166 aa, Homo sapiens
MQKPSCGIVPLASPGTSAELQNNFIEYISFIHQYDARKTPNEPLQGKRHGAFVQREIKPGSRPTVPKGAEVLLNTPGSRSSEQSKKTEKGNSAESRMISPGLCQQNSQELLEPKTHLSETDVRQAAKACPSTLESREKTSGATQTTVGDALFTTHKPLNPPIKKSE

SEQ ID NO: 28761 - protein, 259 aa, Homo sapiens
MDHCLISGLSQLDLPSALTKNWPSKPESCPLALLPGQHELHHLLHPLHQLPVPGHCPGTQLCAQLVSSVASVYAGIRGSGSRISMSCFTSFQGSMGSRGLPAVMAGGLAGMGVIQNEKETMQSLNDHLASYLDRVRSLDTKNWKLESQEHLEKKGPQVRDWSHDFKTIENLRAQIFANTVDSAHIVLQIDNACLAGDDFRVKYETELAMCQSVESDIHGLHKVIDDTNVTWLQLEAEIKALKEKLLFMKKNHEEEVKGL

SEQ ID NO: 28762 - protein, 563 aa, Homo sapiens
MIKRKIWCNLCIDLVAFTSEIFKGAVFQSLDGIVVSANCKLRKIFTLKSKPQDTADKDAVYGVPFSTDEPTDIIPRSCQLMTDVPHVTQLLNMTKLRQTEIKFGGHPLRSAESDQFINRGTSITRNSKNQDVCHIAFGSKVLGPPPLSGRRNNMKISSETVRSVGSKNNRSCQPSTVEKCVNGTEMSALLIPESEEQGNKENIHQIKQTVPIHAANLHIMHPHPPQEPSADKNNNRRRLRLKSTSRERTETPSGSSSGNNRIEDKASTILTTVSQQGAELLNSGTLGPQSPDQSDEWIFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQGEEDLSVEEDEEVLTLLYDPCLNCYFDPQTGKYYELV

SEQ ID NO: 28763 - protein, 94 aa, Homo sapiens
MDGRGAFWTVAIPRARQEGLGRLGLPFPVKRTPPAPQNPGGSTQAPQRVVGKSHSGIRMPAKSRNLRLESKLNRTAVCEALKRAPTTNLPGVGS

SEQ ID NO: 28764 - protein, 175 aa, Homo sapiens
MPQWLVASIIPGCVCESVSRGDSHVSQRAEKETRSQCECALSNQLKARLGTNRQKKEDSLSHLSGAGCLFSLDIRLQGLWLLDSRTCTNGLPGPSGLQPPTKVCAVGLPDSEASGLGLRHATGFSDSPACGWPIMGLLHLCNHKGQCPLIPFFSYILLVLSAWGTLTNTDMEHLK

SEQ ID NO: 28765 - protein, 370 aa, Homo sapiens
MDIDHNCIYLSGLGLFMLYFFYVVLMLCLSTLGKNNDIQKHQGRARRRKKGGTYKDRKSFQREAEEERKLLSILKSFGPPASCSPLGQHHDTTRFHRLLCPDPVCQVCNRATADIQRLLSWESLKDAVPFVSPLASSASATESSFTLASTPSATTPEDLILSPQPKPSLLPHLILSPDLITTLADLFSPSPLRDPLPPQPVSPLDSKFPIDHSLPQQLPSPLFPPHHIQRAEPSLQPEASLSLNTVFLFDSTLSQDMNPLSNISQAMNATDSCAWHHEPPNPSALPLEDCPVTQSKASPTVLKPFPEMLSLGSSGGSSTCAPTIRGIDIHALHLQNSPGGSLMTRTFFLPLLHHMISCKSFLPFILLRSL

SEQ ID NO: 28766 - protein, 407 aa, Homo sapiens
MENVGNYQGYSQETAPKDHLLHDPETSSDEDLRSNSERDLETHMMHLSGNDSGVRLGQKQLENALTVRLSKKFEKINEGRMPGTVHSSWHSVKQTMSLPEKSQSQIKHQNLVALVSEDHCVDTSQEISFLSSNKQKMLEAHIKTFRMRMLWGLPCKVLESIEIFKSEEDISNSFSHFYLPSSASFISQGDSKDGVSKSCRRSTFQGEKLGTTSSVPVLNHPQPVSSPIGKEGQGTLRRQFSDIDHDLIETDAKDGASTPLRRGTTYFQGEKLETTSSFSILGHPHLVTSPVDQEKQGTLRREFADTDEDLTESVWTTEDGRQTFLPPTYSIIDEVIRNRLYLPVDAVQSCPYCKLELAVIQGIRERVPVIMLTGFRAVERPFLSPMGRRRCSRKRRSVLFNHKLGTT

SEQ ID NO: 28767 - protein, 150 aa, Homo sapiens
MSLALDNLSSKDLLTHAQGISNQDLGTSQVLHVHLEVRGIRVAQQQEPRVPTHVLQKCQVKNFSPATKRVSPLRPNGGELGGGDAGLGTSQLRRKSHAIHNKTSRESLGSKSSPTLKTQPPPENLFGTLMKTFLQQSNKPIITYGKQESS

SEQ ID NO: 28768 - protein, 271 aa, Homo sapiens
MTAWILLPVSLSAFSITGIWTVYAMAVMNHHVCPVENWSYNESCPPDPAEQGGPKTCCTLDDVPLISKCGSYPPESCLFSLIGNMGAFMVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 28769 - protein, 218 aa, Homo sapiens
MYALWRTGPTTSPALLTLLSKGVPRPAAPWTMSPSSVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDIPIFYGTFSYEFGAVSSDTLVAALQPTPGRACKSSGSSSTSTHLNCAPESIAMI

SEQ ID NO: 28770 - protein, 555 aa, Homo sapiens
MDVSSEHTKDPGGEGGDGESLAARPSKIKASSGPPTSPEPGELESEPEEEEEEQAASQGGTAADEQAEAPKGLTAAEAAGEEGPGEPGRPAEPQPEPEEPAEVGAEEPAQPEPGAGPEELEAEAGAEELEQAAEGKEVRFQASLPLTRIDEEEAAAAPEAETERVEGEEEDKEETQRDGAESKERDGEGRPAKSQEEGKRLYGRDEFEDLEWSEEVQKLQEQQLRSDLLDQYRSLLVERNRSQRYNLYLQHKIFEALRRKKGLEAAEVADRGAEAEAPEKEQAYLRHLGMLEELKKQQADDLQWYHQELGQLKRQCQEKLTRVEKEWRRFQALKKQVVMQAMGSCRMRGGRQAALREVEQIQALEDKKEKEMSAVRLENIQLKQSLVHFETRMRTQEDLTQGLLLIDFEQLKIENQTFNEKIEERNEELLKLRSKVTNSVQVITHVKEKLHFMDMENACKKTQLAEIEAQAALGRDILTKTKQAREGLRTDNIRLNQKCGLLGKDSLLRDLEEKVDKTELLHRRLESLKRHHASLTLSCRGVRQKIREAKAFLPS

SEQ ID NO: 28771 - protein, 2705 aa, Homo sapiens
MPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 28772 - protein, 255 aa, Homo sapiens
MSSHRRKAKGRNRRSHRAMRVAHLELATYELAATESNPESSHPGYEAAMADRPQPGWRESLKMRVSKPFGMLMLSIWILLFVCYYLSYYLCSGSSYFVLANGHILPNSENAHGQSLEEDSALEALLNFFFPTTCNLRENQVAKPCNELQDLSESECLRHKCCFSSSGTTSFKCFAPFRDVPKQMMQMFGLGAISLILVCLPIYCRSLFWRSEPADDLQRQDNRVVTGLKKQRRKRKRKSEMLQKAARGREEHGDE

SEQ ID NO: 28773 - protein, 233 aa, Homo sapiens
MPCRREEEEEAGEEAEGEEEEDDSFLLLQQSVTLGSSGEVDRLVAQIGETLQLDAAQDSPASPCAPPGVPLRAPGPLAAAVPADKARPPAVPLLLPPASAETVGPAPSGALRCALGDRGRVRGRAAPYCVAEVAAGPSALPGPCRRGWLRDAVTSRRLQQRRWTQAGARAGDDDPHRLLQQLVLSGNLIKEAVRRLQRAVAAVAATGPASAPGPGGGRSGPDRIALQPSGSLL

SEQ ID NO: 28774 - protein, 512 aa, Homo sapiens
MGSCCSCPDKDTVPDNHRNKFKVINVDDDGNELGSGIMELTDTELILYTRKRDSVKWHYLCLRRYGYDSNLFSFESGRRCQTGQGIFAFKCARAEELFNMLQEIMQNNSINVVEEPVVERNNHQTELEVPRTPRTPTTPGFAAQNLPNGYPRYPSFGDASSHPSSRHPSVGSARLPSVGEESTHPLLVAEEQVHTYVNTTGVQEERKNRTSVHVPLEARVSNAESSTPKEEPSSIEDRDPQILLEPEGVKFVLGPTPVQKQLMEKEKLEQLGRDQVSGSGANNTEWDTGYDSDERRDAPSVNKLVYENINGLSIPSASGVRRGRLTSTSTSDTQNINNSAQRRTALLNYENLPSLPPVWEARKLSRDEDDNLGPKTPSLNGYHNNLDPMHNYVNTENVTVPASAHKIEYSRRRDCTPTVFNFDIRRPSLEHRQLNYIQVDLEGGSDSDNPQTPKTPTTPLPQTPTRRTELYAVIDIERTAAMSNLQKALPRDDGTSRKTRHNSTDLPMLAWK

SEQ ID NO: 28775 - protein, 498 aa, Homo sapiens
MDETEWIHRHPKAEDLRVGLISWAGTYLTFEACKNTVTATAKSLGRRQTWEILVSNEHETQAVVRLKSVQGLYLLCECDGTVCYGRPRTSHHGCFLLRFHRNSKWTLQCLISGRYLESNGKDVFCTSHVLSAYHMWTPRPALHVHVILYSPIHRCYARADPTMGRIWVDAAVPCLEECGFLLHFRDGCYHLETSTHHFLSHVDRLFSQPSSQTAFHMQVRPGGLVALCDGEGGMLYPQGTHLLLGMGCNPMRGEEWFILQHCPTWVSLRSKTGRFISVIYDGEVRAASERLNRMSLFQFECDSESPTVQLRSANGYYLSQRRHRAVMADGHPLESDTFFRMHWNCGRIILQSCRGRFLGIAPNSLLMANVILPGPNEEFGILFANRSFLVLRGRYGYVGSSSGHDLIQCNQDQPDRIHLLPCRPGIYHFQAQGGSFWSITSFGTFRPWGKFALNFCIELQGSNLLTVLAPNGFYMRADQSGTLLADSEDITRECIWEF

SEQ ID NO: 28776 - protein, 581 aa, Homo sapiens
MDIIKGNLDGISKPASNSRIRPGSRSSNASLEVLSTEPGSFKVDTASNLNSGKEDHSESSNTENRRTSNDDKQESCSEKIKLAEEGSDEDLDLVQHQIISECSDEPKLKELDSQLQDAIQKMKKLDKILAKKQRREKEIKKQGLEMRIKLWEEIKSAKYSEAWQSKEEMENTKKFLSLTAVSEETVGPSHEEEDTFSSVFHTQIPPEEYEMQMQKLNKDFTCDVERNESLIKSGKKPFSNTEKIELRGKHNQDFIKRNIELAKESRNPVVMVDREKKRLVELLKDLDEKDSGLSSSEGDQSGWVVPVKGYELAVTQHQQLAEIDIKLQELSAASPTISSFSPRLENRNNQKPDHDGERNMEVTPGEKILRNTKEQRDLHNRLREIDEKLKMMKENVLESTSRLSEEQLKCLLDECILKQKSIIKLSSERKKEDIEDVTPVFPQLSRSIISKLLNESETKVQKTEVEDADMLESEECEASKGYYLTKALTGHNMSEALVTEAENMKCLQFSKDVIISDTKDYFMSKTLGIGRLKRPSFLDDPLYGISVSLSSEDQHLKLSSPENTIADEQETKDAAEECKEP

SEQ ID NO: 28777 - protein, 242 aa, Homo sapiens [sequence omitted]

SEQ ID NO: 28778 - protein, 467 aa, Homo sapiens
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPPAMITLNNSVYWQEFEDTCVYECLDGKDCQSFFCCYEECKSGSWRKGRIHIDILELDSYSRVFFPTSFLLFNLVYWVGYLYL

SEQ ID NO: 28779 - protein, 637 aa, Homo sapiens
MMFWRKLPKALFIGLTLAIAVNLLLVFSSKGTLQNLFTGGLHRELPLHLNKRYGAVIKRLSHLEVELQDLKESMKLALRQQENVNSTLKRAKDEVRPLLKAMETKVNETKKHKTQMKLFPHSQLFRQWGEDLSEAQQKAAQDLFRKFGYNAYLSNQLPLNRTIPDTRDYRCLRKTYPSQLPSLSVILIFVNEALSIIQRAITSIINRTPSRLLKEIILVDDFSSNGELKVHLDEKIKLYNQKYPGLLKIIRHPERKGLAQARNTGWEAATADVVAILDAHIEVNVGWAEPILARIQEDRTVIVSPVFDNIRFDTFKLDKYELAVDGFNWELWCRYDALPQAWIDLHDVTAPVKSPSIMGILAANRHFLGEIGSLDGGMLIYGGENVELSLRVWQCGGKVEILPCSRIAHLERHHKPYALDLTAALKRNALRVAEIWMDEHKHMVYLAWNIPLQNSGIDFGDVSSRMALREKLKCKTFDWYLKNVYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPGGAVINRDTKRCLEMKKDLLGSHVLVLQTCSTQVWEIQHTVRDWGQTNSQ

SEQ ID NO: 28780 - protein, 443 aa, Homo sapiens
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKMRLQKHYPARLPTASIVICFYNEECNALFQTMSSVTNLTPHYFLEEIILVDDMSKVDDLKEKLDYHLETFRGKVKIIRNKKREGLIRARLIGASHASGDVLVFLDSHCEVNRVWLEPLLHAIAKDPKMVVCPLIDVIDDRTLEYKPSPLVRGTFDWNLQFKWDNVFSYEMDGPEGSTKPIRSPAMSGGIFAIRRHYFNEIGQYDKDMDFWGRENLELSLRIWMCGGQLFIIPCSRVGHISKKQTGKPSTIISAMTHNYLRLVHVWLDEYKEQFFLRKPGLKYVTYGNIRERVELRKRLGCKSFQWYLDNVFPELEASVNSL

SEQ ID NO: 28781 - protein, 836 aa, Homo sapiens
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSQLGNFRFTLLPPTSPGDTAPKYGSYNVFWTSNPGLPLLTEMVKSRLNSWFQHRPPGASPERYLGLPGSLKWEDRGPSGQGQGQFLIQQVTLKIPFSIEFVFESGSAQAGGNQALPRLAGSLLTQALESHAEGFRERFEKTFQLKEKGLSSGEQALGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVGLGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMCRPFHGWTSLVLLAMAEDY

SEQ ID NO: 28782 - protein, 433 aa, Homo sapiens
MGDWSFLGNILEEVNEHSTVIGRVWLTVLFIFRILILGTAAEFVWGDEQSDFVCNTQQPGCENVCYDEAFPISHIRLWVLQIIFVSTPSLMYVGHAVHYVRMEEKRKSREAEELGQQAGTNGGPDQGSVKKSSGSKGTKKFRLEGTLLRTYICHIIFKTLFEVGFIVGHYFLYGFRILPLYRCSRWPCPNVVDCFVSRPTEKTIFILFMLSVASVSLFLNVMELGHLGLKGIRSALKRPVEQPLGEIPEKSLHSIAVSSIQKAKGYQLLEEEKIVSHYFPLTEVGMVETSPLPAKPFNQFEEKISTGPLGDLSRGYQETLPSYAQVGAQEVEGEGPPAEEGAEPEVGEKKEEAERLTTEEQEKVAVPEGEKVETPGVDKEGEKEEPQSEKVSKQGLPAEKTPSLCPELTTDDARPLSRLSKASSRARSDDLTV

SEQ ID NO: 28783 - protein, 553 aa, Homo sapiens
MAAPKTAAVGPLVGAVVQGTNSTRFLVFNSKTAELLSHHKVELTQEFPKEGWVEQDPKEILQSVYECIARTCEKLDELNIDISNIKAVGVSNQRETTVIWDKLTGEPLYNAVVWLDLRTQTTVEDLSKKIPGNSNFVKSKTGLPLSTYFSAVKLRWMLDNVRNVQKAVEEGRALFGTIDSWLIWSLTGGVNGGVHCTDVTNASRTMLFNIHSLEWDKELCDFFEIPMDLLPNVFSSSEIYGLIKTGALEGVPISGCLGDQCAALVGQMCFQEGQAKNTYGTGCFLLCNTGRKCVFSEHGLLTTVAYKLGREKPAYYALEGSVAIAGAVIRWLRDNLGIIETSGDIERLAKEVGTSYGCYFVPAFSGLYAPYWEPSARGILCGLTQFTNKCHIAFAALEAVCFQTREILEAMNRDCGIPLRHLQVDGGMTNNKVLMQLQADILHIPVIKPFMPETTALGAAMAAGAAEGVSVWSLEPQALSVLRMERFEPQIQATESEIRYATWKKAVMKSMGWVTSQSPEGGDPSIFSSLPLGFFIVSSMVMLIGARYISGVP

SEQ ID NO: 28784 - protein, 366 aa, Homo sapiens
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQLTSEMFEADLEKALLLSKLEYEEHKKEYEDAENTSTQSKVMNKKDKRKNHQGKDRPLTVSLKDFHSEDHISKKTEELSSSQTLSHDGGFFNRLEDDVHKILIREKRREQLTEYNGTDNCTAHEHNQEVVLKDGRIERLKLELERKDAEIQKLKNVITQWEAKYKEVKARNAQLLKMLQEGEMKDKAEILLQVDESQSIKNELTIQVTSLHAALEQERSKVKVLQAELAKYQGGRKGKRNSESDQCR

SEQ ID NO: 28785 - protein, 526 aa, Homo sapiens
MGSSSSRVLGQPRRALAQQEQGARARGSARRPDTGDDAASYGFCYCPGSHKRKRSSGACRYCDPDSHREEHEEEGDKQQPLLNTPARKKLRSTSKYIYQTLFLNGENSDIKICALGEEWRLHKIYLCQSGYFSSMFSGSWKESSMNIIELEIPDQNIDVDALQVAFGSLYRDDVLIKPSRVVAILAAACMLQLDGLIQQCGETMKETINVKTVCGYYTSVEIYGLDSVKEKCLEWLLNNLMTHQNVKLFKELGINVMKQLIGSSNLFVMQVEMDVYTTLKKWMFLQLVPSWNGSLKQLLTETDVWFSKQRKDFEGMAFLETEPGKPFVSVFRHLRLQYIISDLASARIIEQDGIVPSEWLSSVYKQQWFAMLRAEQDHEVGPQEINKEDLEGSSMRCGRKLAKDGEYYWCWTGFNFGFDLLVIYTNGYIIFKRNTLNQPCSGSVSLRPRRSIAFRLRLASFDSSGKLVCSRTTGYQILILKKDQEQVVMNLDSRFLTFPLYICCNFLYISPEKGIENNRHPEDPEN

SEQ ID NO: 28786 - protein, 359 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQREPQAAREFILKMFVDLNPDSDKIIYSHFTCATDTENIRFVFAAVKDTILQLNLKEYNLV

SEQ ID NO: 28787 - protein, 731 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTFQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 28788 - protein, 434 aa, Homo sapiens
MEWKLEQSMREQALLKAQLTQLKESLKEVQLERDEYAEHLKGERARWQQRMRKMSQEVCSLKKEKKHDKYRVETLERSLSKLKHQMAEPLPPEPPAVPSEVELQHLRKELERVAGALQAQVEYNQRISLLNEGQKERLREQEERLQEQQERLREQEERLQQLAEPQNSFKELNNENKSVLQLEQQVKELQEKLGKVKETERLEAASQQKQQLTAQLSLMALPGEGHGGEHLDSEGEEAPRPMPSVPQDLESREAMSGFMDHLEEKADLSELVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGETREGSPHDKPTAQPIVQDHQEHPGLGSNCCVPFFCWAWPPRRRR

SEQ ID NO: 28789 - protein, 434 aa, Homo sapiens
MEWKLEQSMREQALLKAQLTQLKESLKEVQLERDEYAEHLKGERARWQQRMRKMSQEVCSLKKEKKHDKYRVEKLERSLSKLKNQMAEPLPPEPPAVPSEVELQHLRKELERVAGALQAQVEYNQRISLLNEGQKERLREQEERLQEQQERLPEQEERLRQLAEPQNSFKELNNENKSVLQLEQQVKELQEKLGKVKETERLEAASQQKQQLTAQLSLMALPGEGHGGEHLDSEGEEAPRPMPSVPEDLESREAMSGFMDHLEEKADLSELVEKEELGFFQYYREGCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 28790 - protein, 430 aa, Homo sapiens
MEWKLEQSMREQALLKAQLTQLKESLKEVQLERDEYAEHLKGERARWQQRMRKMSQEVCSLKKEKKHDKYRVETLERSLSKLKHQMAEPLPPEPPAVPSEVELQHLRKELERVAGALQAQVEYNQRISLLNEGQKERLREQEERLQEQQERLREQEERLQQLAEPQNSFKELNNENKSVLQLEQQVKELQEKLGKERLEATSQQKQQLTAQLSLMALPGEGHGGEHLDSEGEEAPRPMPSVPEDLESREAMSGFMDHLEEKADLSELVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 28791 - protein, 434 aa, Homo sapiens
MEWKLEQSMREQALLKAQLTQLKESLKEVQLERDEYAEHLKGERARWQQRMRKMSQEVCSLKKEKKHDKYRVEKLERSLSKLKHQMAEPLPPEPPAVPSEVELQHLRKELERVAGELQAQVEYNQRISLLNEGQKERLREQEERLQEQQERLPEQEERLQQLAEPQNSFKELNNENKSVLQLEQQVKELQEKLGKVKETERLEAASQQKQQLTAQLSLMALPGEGDGGGHLDSEGEEAPRPIPSIPQDLESREAMSGFMDHLEEKADLSELVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 28792 - protein, 284 aa, Homo sapiens
MEWKLEQSMREQALLKAQLTQLKESLKEVQLERDEYAEHLKGERARWQQRMRKMSQEVCSLKKEKKHDKYRVEKLERSLSKLKHQMAEPLPPEPPAVPSEVELQHLRKELERVAGELQAQLVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 28793 - protein, 434 aa, Homo sapiens
MEWKLEQSMREQALLKAQLTQLKESLKEVQLERDEYAEHLKGERARWQQRMRKMSQEVCSLKKEKKHDKYRVEKLERSLSKLKHQMAEPLPPEPPAVPSEVELQHLRKELERVAGELQAQVEYNQRISLLNEGQKERLREQEERLQEQQERLPEQEERLQQLAEPQNSFKELNNENKSVLQLEQQVKELQEKLGKVKETERLEAASQQKQQLTAQLSLMALPGEGDGGGHLDSEGKEAPRPIPSIPQDLESREAMSGFMDHLEEKADLSELVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 28794 - protein, 874 aa, Homo sapiens
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 28795 - protein, 662 aa, Homo sapiens
MEGAPTVRQVMNEGDSSLATDLQEDVEENPSPTVEENNVVVKKQGPNLHNWSGDWSFWISSSTYKDRNEEYRRQFTHLPDTERLIADYACALQRDILLQGRLYLSENWLCFYSNIFRWETTISIALKNITFMTKEKTARLIPNAIQIVTESEKFFFTSFGARDRSYLSIFRLWQNVLLDKSLTRQEFWQLLQQNYGTELGLNAEEMENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMPQKTFDLLNKNKTGMAVES

SEQ ID NO: 28796 - protein, 607 aa, Homo sapiens
MWMNSILPIFLFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 28797 - protein, 602 aa, Homo sapiens
MSNELDFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 28798 - protein, 509 aa, Homo sapiens
MEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 28799 - protein, 255 aa, Homo sapiens
MEQALTGEAQSRWPRRGGSGAMAEAPGPSGESRGHSATQLPAEKTVGGPSRGCSSSVLRVSQLVLQAISTHKGLTLAALKKELRNAGYEVRRKSGRHEAPRGQAKATLLRVSGSDAAGYFRVWKVPKPRRKPGRARQEEGTRAPWRTPAAPRSSRRRRQPLRKAARKAREVWRRNARAKAKANARARRTRRARPRAKEPPCARAKEEAGATAADEGRGQAVKEDTTPRSGKDKRRSSKPREEKQEPKKPAQRTIQ

SEQ ID NO: 28800 - protein, 684 aa, Homo sapiens
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 28801 - protein, 106 aa, Homo sapiens [sequence omitted]

SEQ ID NO: 28802 - protein, 106 aa, Homo sapiens [sequence omitted]

SEQ ID NO: 28803 - protein, 106 aa, Homo sapiens [sequence omitted]

SEQ ID NO: 28804 - protein, 251 aa, Homo sapiens
MSAYGMPMYKSGDLVFAKLKGYAHWPAGIERMTQPNRYQVFFFGTHETAFLSPKRLFPYKECKEKFGKPNKRRGFSAGLWEIENNPTVQASYCPLASEKGSGDGPWPEPEAAEGDEDKPTHAGGGGDELGKPDDDKPTEEEKGPLKRSAGDPPEDAPKRPKEAAPDQEEEAEAERAAEAERAAAAAAATAVDEESPFPVAVENGSAPSEPGLVCEPPQPEEEELREEEVADEEASQEWHAEAPGGGDRDSL

SEQ ID NO: 28805 - protein, 484 aa, Homo sapiens
MDLGKDQSHLKHHQTPDPHQEENHSPEVIGTWSLRNRELLRKRKAEVHEKETSQWLFGEQKKRKQQRTGKGNRRGRKRQQNTELKVEPQPQIEKEIVEKALAPIEKKTEPPGSITKVFPSVASPQKVVPEEHFSEICQESNIYQENFSEYQEIAVQNHSSETCQHVSEPEDLSPKMYQEISVLQDNSSKICQDMKEPEDNSPNTCQVISVIQDHPFKMYQDMAKREDLAPKMCQEAAVPKILPCPTSEDTADLAGCSLQAYPKPDVPKGYILDTDQNPAEPEEYNETDQGIAETEGLFPKIQEIAEPKDLSTKTHQESAEPKYLPHKTCNEIIVPKAPSHKTIQETPHSEDYSIEINQETPGSEKYSPETYQEIPGLEEYSPEIYQETSQLEEYSPEIYQETPGPEDLSTETYKNKDVPKECFPEPHQETGGPQGQDPKAHQEDAKDAYTFPQEMKEKPKEEPGIPAILNESHPENDVYSYVLF

SEQ ID NO: 28806 - protein, 484 aa, Homo sapiens; identical to SEQ ID NO: 28805

SEQ ID NO: 28807 - protein, 112 aa, Homo sapiens
MMNYVGKRKKRRKRDPQEPRRPPSSFLLFCQDHYAQLKRENPNWSVVQVAKATGKMWSTATDLEKHPYEQRVALLRAKYFEELELYRKQCNARKKYRMSARNRCRGKRVRQS

SEQ ID NO: 28808 - protein, 186 aa, Homo sapiens
MGKEIQLKPKANVSSYVHFLLNYRNKFKEQQPNTYVGFKEFSRKCSEKWRSISKHEKAKYEALAKLDKARYQEEMMNYVGKRKKRRKRDPQEPRRPPSSFLLFCQDHYAQLKRENPNWSVVQVAKATGKMWSTATDLEKHPYEQRVALLRAKYFEELELYRKQCNARKKYRMSARNRCRGKRVRQS

SEQ ID NO: 28809 - protein, 392 aa, Homo sapiens
MVEADRPGKLFIGGLNLETDEKALEAEFGKYGRIVEVLLMKDRETNKSRGFAFVTFESPADAKAAARDMNGKSLDGKAIKVAQATKPAFESSRRGPPPPRSRGRPRFLRGTRGGGGGPRRSPSRGGPDDDGGYAADFDLRPSRAPMPMKRGPPPRRVGPPPKRAAPSGPARSSGGGMRGRALAVRGRDGYSGPPRREPLPPRRDPYLGPRDEGYSSRDGYSSRDYREPRGFAPSPGEYTHRDYGHSSVRDDCPLRGYSDRDGYGGRDRDYGDHLSRGSHREPFESYGELRGAAPGRGTPPSYGGGGRYEEYRGYSPDAYSGGRDSYSSSYGRSDRYSRGRHRVGRPDRGLSLSMERGCPPQRDSYSRSGCRVPRGGGRLGGRLERGGGRSRY

SEQ ID NO: 28810 - protein, 730 aa, Homo sapiens
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 28811 - protein, 691 aa, Homo sapiens
MAAGVEAAAEVAATEIKMEEESGAPGVPSGNGASGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGECARRAMQKAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGPSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 28812 - protein, 394 aa, Homo sapiens
MATAQLQRTPMSALVFPNKISTEHQSLVLVKRLLAVSVSCITYLRGIFPECAYGTRYLDDLCVKILREDKNCPGSTQLVKWMLGCYDALQKKYLRMVVLAVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 28813 - protein, 168 aa, Homo sapiens
MAFNDCFSLNYPGNPCPGDLIEVFRPGYQHWALYLGDGYVINIAPVDGIPASFTSAKSVFSSKALVKMQLLKDVVGNDTYRINNKYDETYPPLPVEEIIKRSEFVIGQEVAYNLLVNNCEHFVTLLRYGEGVSEQANRAISTVEFVTAAVGVFSFLGLFPKGQRAKYY

SEQ ID NO: 28814 - protein, 279 aa, Homo sapiens
MGLSPGAEGEYALRLPRIPPPLPKPASRTAGTGPKDQPPALRRSAVPHSGLNSISPLELEESVGFAALVQLPAKQPPPGTLEQGRSIQQGEKAVVSLETTPSQKADWSSIPKPENEGKLIKQAAEGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCEHFVNGLRYGVPRSQQVEHALMEGAKAAGAVISAVVDSIKPKPITA

SEQ ID NO: 28815 - protein, 68 aa, Homo sapiens
MALELYMDLLSAPCRAVYIFSKKHDIQFNFQFVDLLKGHHHSKEYIDINPLRKLPSLKDGKFILSESC

SEQ ID NO: 28816 - protein, 401 aa, Homo sapiens
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKLKFYYNPNFKRGYPQLLVRVKRRIGVKNASPISTLFNEDFNKKHFRAGANMENHNSALAAEASEESLFSASKNLNMPLTRESSVRQIIANSSVPIRSGFPPPSPSTSVGPSEQIATDQHAILNQLTTIHMHSHSTYMQARGHIVNFITTTTSQYHIISPLQNGYFGLTVEPSAVPTRYPLVSVNEAPYRNMLPAGNPWLQMPTIADRSAAPHSRLALQPSPLDKYHPNYN

SEQ ID NO: 28817 - protein, 839 aa, Homo sapiens
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSEHNGPMDGQSGTETKSDSTKDSSQHTKSSGEMEVD

SEQ ID NO: 28818 - protein, 1019 aa, Homo sapiens
MRYRLAWLLHPALPSTFRSVLGARLPPPERLCGFQKKTYSKMNNPAIKRIGNHITKSPEDKREYRGLELANGIKVLLMSDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLVVKLFSEVENKNVPLPEFPEHPFQEEHLKQLYKIVPIKDIRNLYVTFPIPDLQKYYKSNPGHYLGHLIGHEGPGSLLSELKSKGWVNTLVGGQKEGARGFMFFIINVDLTEEGLLHVEDIILHMFQYIQKLRAEGPQEWVFQECKDLNAVAFRFKDKERPRGYTSKIAGILHYYPLEEVLTAEYLLEEFRPDLIEMVLDKLRPENVRVAIVSKSFEGKTDRTEEWYGTQYKQEAIPDEVIKKWQNADLNGKFKLPTKNEFIPTNFEILPLEKEATPYPALIKDTVMSKLWFKQDDKKKKPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQSLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 28819 - protein, 2491 aa, Homo sapiens
MGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWRTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHAVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 28820 - protein, 431 aa, Homo sapiens
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 28821 - protein, 430 aa, Homo sapiens
MSLVELLLWWNCFSRTGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 28822 - protein, 221 aa, Homo sapiens
MQVQDDGVNLIPFAKCSRVVSRSPPPRLPSQSLRPMPQRYGDVFWKNLNQRPTPTWLEEQHIPPMLLPPPEMLWRRKKRRPCLEGMQQQGLGGVPARVRAVTYHLEDLRRRQSIINELKKAQWGSSGAASEPVVLGEDGCGFPSTNEYPDLEEERATYPQEEDRFLTPGRAQLLWSPWSPLDQEEACASRQLHSLASFSTVTARRNPLHNPWGMELAASEE

SEQ ID NO: 28823 - protein, 131 aa, Homo sapiens
MDPRLPAWALVLLGPALVFALGPAPTPEMREKLCGHHFVRALVRVCGGPRWSTEARRPATGGDRELLQWLERRHLLHGLVADSNLTLGPGLQPLPQTSHHHRHHRAAATNPARYCCLSGCTQQDLLTLCPY

SEQ ID NO: 28824 - protein, 205 aa, Homo sapiens
MEEKQPQKTKEPSKEDEPQQKEMPTHLSLGAESKAEAKTPVLVETQTVDNANEKSEKPPENQKKLSDKDTVATKIKAWWRGTLVRRALLHAALSACIIQCWWRLILSKILKKRRQAALEAFSRKEWAAVTLQSQARMWRIRRRYCQVLNAVRIIQAYWRCRSCASRGFIKGQYRVTANQLHLQLEILLDSGPCIVTECIPFSIKE

SEQ ID NO: 28825 - protein, 164 aa, Homo sapiens
MRVRFCTKGNLILVIIEDVEESIEWKTLQKKKQQKIKEKLRIRTKAAVKIQAWWRGTLVRRTLLHAALRAWIIQCWWRMTLSRVLEKKRQAALIAYATRERAVIKLQSLVRMWRVRWRYCQVLNAIYIIQGHWQCHNCQTCALLQGHCVVTATHLQFHIEIINS

SEQ ID NO: 28826 - protein, 154 aa, Homo sapiens
MGSKCCKGGPDEDAVERQRRQKLLLAQLHHRKRVKAAGQIQAWWRGVLVRRTLLVAALRAWMIQCWWRTLVQRRIRQRRQALLRVYVIQEQATVKLQSCIRMWQCRQCYRQMCNALCLFQVPESSLAFQTDGFLQVQYAIPSKQPEFHIEILSI

SEQ ID NO: 28827 - protein, 60 aa, Homo sapiens
MGSKCCKGGPDEDAVERQRRQKNSQKSEPTQMGEWIDNLWYMHITDYSSAIKSVDLKGRG

SEQ ID NO: 28828 - protein, 93 aa, Homo sapiens
MGSKCCKGGPDEDAVERQRRQKGLDDSVLVEDVGAETDPSAAAGPVEGLRHPGAGDGQAPVLHPHVAVPAMLPPNVQCSLLVPGPREQPCLPD

SEQ ID NO: 28829 - protein, 154 aa, Homo sapiens; identical to SEQ ID NO: 28826

SEQ ID NO: 28830 - protein, 60 aa, Homo sapiens; identical to SEQ ID NO: 28827

SEQ ID NO: 28831 - protein, 93 aa, Homo sapiens; identical to SEQ ID NO: 28828

SEQ ID NO: 28832 - protein, 1338 aa, Homo sapiens
MASPPRHGPPGPASGDGPNLNNNNNNNNHSVRKCGYLRKQKHGHKRFFVLRGPGAGGDEATAGGGSAPQPPRLEYYESEKKWRSKAGAPKRVIALDCCLNINKRADAKHKYLIALYTKDEYFAVAAENEQEQEGWYRALTDLVSEGRAAAGDAPPAAAPAASCSASLPGALGGSAGAAGAEDSYGLVAPATAAYREVWQVNLKPKGLGQSKNLTGVYRLCLSARTIGFVKLNCEQPSVTLQLMNIRRCGHSDSFFFIEVGRSAVTGPGELWMQADDSVVAQNIHETILEAMKALKELFEFRPRSKSQSSGSSATHPISVPGARRHHHLVNLPPSQTGLVRRSRTDSLAATPPAAKCSSCRVRTASEGDGGAAAGAAAAGARPVSVAGSPLSPGPVRAPLSRSHTLSGGCGGRGSKVALLPAGGALQHSRSMSMPVAHSPPAATSPGSLSSSSGHGSGSYPPPPGPHPPLPHPLHHGPGQRPSSGSASASGSPSDPGFMSLDEYGSSPGDLRAFCSHRSNTPESIAETPPARDGGGGGEFYGYMTMDRPLSHCGRSYRRVSGDAAQDLDRGLRKRTYSLTTPARQRPVPQPSSASLDEYTLMRATFSGSAGRLCPSCPASSPKVAYHPYPEDYGDIEIGSHRSSSSNLGADDGYMPMTPGAALAGSGSGSCRSDDYMPMSPASVSAPKQILQPRAAAAAAAAVPSAGPAGPAPTSAAGRTFPASGGGYKASSPAESSPEDSGYMRMWCGSKLSMEHADGKLLPNGDYLNVSPSDAVTTGTPPDFFSAALHPGGEPLRGVPGCCYSSLPRSYKAPYTCGGDSDQYVLMSSPVGRILEEERLEPQATPGPSQAASAFGAGPTQPPHPVVPSPVRPSGGRPEGFLGQRGRAVRPTRLSLEGLPSLPSMHEYPLPPEPKSPGEYINIDFGEPGARLSPPAPPLLASAASSSSLLSASSPASSLGSGTPGTSSDSRQRSPLSDYMNLDFSSPKSPKPGAPSGHPVGSLDGLLSPEASSPYPPLPPRPSASPSSSLQPPPPPPAPGELYRLPPASAVATAQGPGAASSLSSDTGDNGDYTEMAFGVAATPPQPIAAPPKPEAARVASPTSGVKRLSLMEQVSGVEAFLQASQPPDPHRGAKVIRADPQGGRRRHSSETFSSTTTVTPVSPSFAHNPKRHNSASVENVSLRKSSEGGVGVGPGGGDEPPTSPRQLQPAPPLAPQGRPWTPGQPGGLVGCPGSGGSPMRRETSAGFQNGLNYIAIDVREEPGLPPQPQPPPPPLPQPGDKSSWGRTRSLGGLISAVGVGSTGGGCGGPGPGALPPANTYASIDFLSHHLKEATIVKE

SEQ ID NO: 28833 - protein, 2303 aa, Homo sapiens
MIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEETLKNSQPPWDQIQEDKKHEEAEKRKSVDTQLQEDMIIHSSEQSTVSDHNSNDLLPQECNMDKTHTMELLPKEKFVSRPPTPKCVIDITNDTNLEKVAQENSSTFGLQTLQKMDPNVSDSKHSIANAKFLETAKKDSDQSWVSDVVKVDLTQSSVTNASSGNDHLNMEKEKYVSYISPLSAVSVMEDKLHKRSPPPETIKSKLNTSVDTHKIKSSPSPEVVKPKITHSPDSVKSKATYVNSQATGERRLANKIEHELSRCSFHPIPTRSSTLETTKSPLIIDKNEHFTVYRDPALIGSETGANHISPFLSQHPFPLHSSSHRTCLNPGTHHPALTPAPHLLAGSSSQTPLPTINTHPLTSGPHHAVHHPHLLPTVLPGVPTASLLGGHPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLRSVASTSAKNDLDLNRSQTGKDCHLHRHFVDPVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQSQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHLVESFHLTQELRLLKEEINYDDKLQVKNILYHAVKEMVRALKIHEDEVEDMEEN

SEQ ID NO: 28834 - protein, 523 aa, Homo sapiens
METMKSKANCAQNPNCNIMIFHPTKEEFNDFDKYIAYMESQGAHRAGLAKIIPPKEWKARETYDNISEILIATPLQQVASGRAGVFTQYHKKKKAMTVGEYRHLANSKKYQTPPHQNFEDLERKYWKNRIYNSPIYGADISGSLFDENTKQWNLGHLGTIQDLLEKECGVVIEGVNTPYLYFGMWKTTFAWHTEDMDLYSINYLHLGEPKTWYVVPPEHGQRLERLARELFPGSSRGCGAFLRHKVALISPTVLKENGIPFNRITQEAGEFMVTFPYGYHAGFNHGFNCAEAINFATPRWIDYGKMASQCSCGEARVTFSMDAFVRILQPERYDLWKRGQDRAVVDHMEPRVPASQELSTQKEVQLPRRAALGLRQLPSHWARHSPWPMAARSGTRCHTLVCSSLPRRSAVSGTATQPRAAAVHSSKKPSSTPSSTPGPSAQIIHPSNGRRGRGRPPQKLRAQELTLQTPAKRPLLAGTTCTASGPEPEPLPEDGALMDKPVPLSPGLQHPVKASGCSWAPVP

SEQ ID NO: 28835 - protein, 511 aa, Homo sapiens
MSRQLTHFPRGERLGFSGCSAVLSGGIGSSSASFRARVKGSASFGSKSLSCLGGSRSLALSAAARRGGGRLGGFVGTAFGSAGLGPKCPSVCPPGGIPQVTVNKSLLAPLNVEMDPEIQRVRAQEREQIKALNNKFASFIDKVRFLEQQNQVLETKWNLLQQLDLNNCRKNLEPIYEGYISNLQKQLEMLSGDGVRLDSELRNMQDLVEDYKKRYEVEINRRTAAENEFVVLKKDVDAAYMNKVELQAKVDSLTDEIKFFKCLYEGEITQIQSHISDTSIVLSMDNNRDLDLDSIIAEVRAQYEEIALKSKAEAETLYQTKIQELQVTAGQHGDDLKLTKAEISELNRLIQRIRSEIGNVKKQCADLETAIADAEQRGDCALKDARAKLDELEGALHQAKEELARMLREYQELVSLKLALDMEIATYRKLLESEECRMSGEYPNSVSISVISSTNAGAGGAGFSMGFGASSSYSYKTAAADVKTKGSCGSELKDPLAKTSGSSCATKKASR

SEQ ID NO: 28836 - protein, 736 aa, Homo sapiens
MDTSGHFHDSGVGDLDEDPKCPCPSSGDEQQQQQQQQQQQQPPPPAPPAAPQQPLGPSLQPQPPQLQQQQQQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 28837 - protein, 426 aa, Homo sapiens
MERPIKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 28838 - protein, 442 aa, Homo sapiens
MSAAQGWDRNRRRGGGAAGAGGGGSGAGGGSGGSGGRGTGQLNRFVQLSGRPHLPGKKKIRWDPVRRRFIQSCPIIRIPNRFLRGHRPPPARSGHRCVADNTNLYVFGGYNPDYDESGGPDNEDYPLFRELWRYHFATGVWHQMGTDGYMPRELASMSLVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLNKIHAYNLETNAWEEIATKPHEKIGFPAARRCHSCVQIKNDVFICGGYNGEVILGDIWKLNLQTFQWVKLPATMPEPVYFHCAAVTPAGCMYIHGGVVNIHENKRTGSLFKIWLVVPSLLELAWEKLLAAFPNLANLSRTQLLHLGLTQGLIERLK

SEQ ID NO: 28839 - protein, 1053 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVSLDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 28840 - protein, 1373 aa, Homo sapiens
  VARIANT 647, 653, 655, 658, 665, 677, 680, 694, 711, 721, 722, 724,725, 739, 745, 753, 761, 778, 793, 807, 811, 821, 852, 855,862, 863, 872, 892, 899, 920, 927, 929, 940, 953, 958, 965,967, 971, 975, 977, 979, 981, 989, 1019, 1046, 1056: Xaa = Any Amino Acid
  VARIANT 1062, 1085, 1087, 1103, 1105, 1115, 1124, 1144, 1163, 1169,1192, 1194, 1197, 1201, 1228, 1237, 1255, 1267, 1268, 1275,1285, 1291, 1294, 1296, 1297, 1337, 1338, 1339, 1340, 1356: Xaa = Any Amino Acid
MVSWGGEKRGGAEGSPKPAVYATRKTGSVRSQEDQWYLGYPGDQWSSGFSYSWWKNSVGSESKHGEGALDQPQHDVRLEDLGELHRAARSGDVPGVEHVLVPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDLELTSEEEQERLKGCENKQPQKTSQEPEMAKDCDREDIPIYPVLPHVQKSEEMRIEQGKLEWKNQLKLVINELKQRFGEIYEKYKIPACPEEEPLLDNSTRGTDVKDIPFNLTNNIPGCEEEDASEISVSVVFETFPEQKEPSLKNIIHSYYHPYSGSQEHVCQSSSKLHLHENKLDCDNDNKPGIGHIFSTDKNFHNDASTKKARNPEVVTVEMKEDQEFDLQMTKNMNQNSDSGSTNNYKSLKPKLENLSSLPPDSDRTSEVYLHEELQQDMQKFKNEVNTLEEEFLALKKENVQLHKEVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQERHILFVXTLTETXEXSLXPTYSKTXTNGKYGQCTTKXAIXNKKDKITVRTSKNXMGERAVRFETCLKTRKXGEKKCRYVVXXRXXTVKNKRRGVWESGXNKATTXMESEKTCXGIEDSKKXLGSGCAGEKRCPEATFXRTGCQNITRSDSDEXTKGTRNGSEEKESXDFSXASERKGSLSXKLHVAGRNCLAETGNRYNKKSEQAKGKEIFXGHXGCERKEXXPSKNYKTKXGNINRNNTPVQWTAEQSDSXEQNAQFXTGEWEREPRKTRNRNGIIPLXTGCCCTXLXSKSDSKRPKTXFPENKTRVGSFTXQNEGXYVWPTSXEXDSFXKTFXCXKXNXQPTNSAPXHKRCSWKREFDFGTCAKRPQPNTVSEERNXTNVPKQTEEIHCQAGICRGEIISTTKXKYVASTATGXCSQESXQSRKDNQYYPRPVSFCCQKSSSXEXKADSFTTREEQGADGXIXSFKRKNGSMXERESRKKNXPYRSTGNCTFTMSTSGCREXSSSTSTDIILYESNTKAMXNTTEEXEAAETRSSKPQKLYGKKYVRTWXSXMAXTVDXRKSKEGDRRKIKRSHSHLAETSSSISXTVSTVKGGXYYFNKNSDGTHSHRSGIXNLQNKNFASRLXXNQIGKIXGTLPRRSESXRILVKXTQXNXXDDSRGQYTTYCGERADQIQISIHCLCYKASPRVTLRWKSXXXXRSQQKTYSKKKEVCSXGHGELLVEMQQKLQNDL

SEQ ID NO: 28841 - protein, 692 aa, Homo sapiens
MFNCRLALKQENEEKRNADMLYNKDSEQLRIKEEECGKVVETKQQLKWNLRRLVKELRTVRNNLDLVVQERNDAQKQLSEEQDARILQDQILTSKQKELEMAQKKRNPEISHRHQKEKDLFHENCMLQEEIALLRLEIDTIKNQNKQKEKKYFEDIEVVKEKNDNLQKIIKRNEETLTETILQYSGQLNNLTAENKMLNSELENGKENQERLEIEMESYRCRLAAAVHDCDQSQTARDLKLDFQRTRQEWVRLHDKMKVDMSGLQAKNEILSEKLSNAESKINSLQIQLHNTRDALGRESLILERVQRDLSQTQCQKKETEQMYQSKLKKYIAKQESVEERLSQLQSENMLLRQQLDDVHKKANSQEKTISTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGEAEWHKLLIEERARKEIEEKLNEAILTLQKQAAVSHEQLAQLREDNTTSIKTQMELTVIDLESEISRIKTSQADFNKTKLERYKELYLEEVKVRESLSNELSRTNEMIAEVSTQLTVEKEQTRSRSLFTAYATRPVLESPCVGNLNDSEGLNRKHIPRKKRSALKDMESYLLKFSYLFSFGVQISDRILVCYLVKYSVT

SEQ ID NO: 28842 - protein, 1157 aa, Homo sapiens
  VARIANT 367, 373, 375, 378, 385, 397, 400, 414, 431, 441, 442, 444,445, 459, 465, 473, 481, 498, 513, 527, 531, 541, 572, 575,582, 583, 592, 612, 619, 640, 647, 649, 660, 673, 678, 685,687, 691, 695, 697, 699, 701, 709, 739, 766, 776, 782: Xaa = Any Amino Acid
  VARIANT 805, 807, 823, 825, 835, 871, 874, 888, 890, 910, 929, 935,958, 960, 963, 967, 994, 1003, 1021, 1033, 1034, 1041, 1051,1057, 1060, 1062, 1063, 1103, 1104, 1105, 1106, 1122, 1132,1143, 1144: Xaa = Any Amino Acid
MVSWGGEKRGGAEGSPKPAVYATRKTGSVRSQEDQWYLGYPGDQWSSGFSYSWWKNSVGSESKHGEGALDQPQHDVRLEDLGELHRAARSGDVPGVEHVLVPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDLELTSEEEQERLKGCENKQPQVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQERHILFVXTLTETXEXSLXPTYSKTXTNGKYGQCTTKXAIXNKKDKITVRTSKNXMGERAVRFETCLKTRKXGEKKCRYVVXXRXXTVKNKRRGVWESGXNKATTXMESEKTCXGIEDSKKXLGSGCAGEKRCPEATFXRTGCQNITRSDSDEXTKGTRNGSEEKESXDFSXASERKGSLSXKLHVAGRNCLAETGNRYNKKSEQAKGKEIFXGHXGCERKEXXPSKNYKTKXGNINRNNTPVQWTAEQSDSXEQNAQFXTGEWEREPRKTRNRNGIIPLXTGCCCTXLXSKSDSKRPKTXFPENKTRVGSFTXQNEGXYVWPTSXEXDSFXKTFXCXKXNXQPTNSAPXHKRCSWKREFDFGTCAKRPQPNTVSEERNXTNVPKQTEEIHCQAGICRGEIISTTKXKYVASTATGXCSQESXQSRKDNQYYPRPVSFCCQKSSSXEXKADSFTTREEQGADGXIXSFKRKNGSMXERESRKKSSYERIPARMDRSPKTTTYVRGYLTLSHXFRXDTGFKEEIGSNQKXNXPYRSTGNCTFTMSTSGCREXSSSTSTDIILYESNTKAMXNTTEEXEAAETRSSKPQKLYGKKYVRTWXSXMAXTVDXRKSKEGDRRKIKRSHSHLAETSSSISXTVSTVKGGXYYFNKNSDGTHSHRSGIXNLQNKNFASRLXXNQIGKIXGTLPRRSESXRILVKXTQXNXXDDSRGQYTTYCGERADQIQISIHCLCYKASPRVTLRWKSXXXXRSQQKTYSKKKEVCSXGHGELLVEVXLSFFLRRSDFXXNSCMLFGKILSYL

SEQ ID NO: 28843 - protein, 1379 aa, Homo sapiens
MASSPTKGLTMSVPVAPKKSCYTQLRDNRNAARNNNESILSLGDTNANQIMLEVSSSHDESKTCDLGDEIGNTNSSEPENRTHFHKEFHQLQGFGKGSQAGSASLKDFRLSSTIQRELNEEHTVERGTDSLQTTRSIQGPSLSSWRNVMSEASLDVLAKRDAEIPRHVPKDKLAKTLDNEELRRHSLERASSSVAAVGSLTPQHPQPLSLDSREARGQIPGGGEGPQKTLPDHAVPAAFPATDSTSEGKSVRHPKPSTSESKQSTPSETQTVGAHVLQVCSEHTSHSAHPEPALNLTLASKEIPSKLEAQLGQGKGEAKLDLKYVPPRRVEQEGKAAQEGYLGCHKEENLSALEGRDPCGEAHPEATDALGHLLNSDLHHLGVGRGNCEEKRGVNPGEQDSLHTTPKQGSASLGGADNQPTGKISPCAGEKLGERTSSSFSPGDSHVAFIPNNLTDSKPLDVIEEERRLGSGNKDSVMVLVFNPSVGENKTEVPEPLDPQSGRSEARESKEVTTSVAENRNLLENADKIESTSARADSVLNIPAPLHPETTVNMTYQPTTPSSSFQDVSVFGMDAGSPLVVPPPTDSARLLNTSPKVPDKNTCPSGIPKPVFTHSKDTPSSQEGMENYQVEKTEERTETKPIIMPKPKHVRPKIITYIRRNPQALGQVDASLVPVGLPYAPPTCTMPLPHEEKAAGGDLKPSANLYEKFKPDLQKPRVFSSGLMVSGIKPPGHPFSQMSEKFLQEVTDHPGKEEFCSPPYAHYEVPPTFYRSAMLLKPQLGLGAMSRLPSAKSRILIASQRSSASAIHPPGPITTATSLYSSDPSADLKKASSSNAAKSNLPKSGLRPPGYSRLPAAKLAAFGFVRSSSVSSVSSTQSGDSAQPEQGRPATRSTFGNEEQPVLKASLPSKDTPKGAGRVAPPASSSVTAPRRSLLPAPKSTSTPAGTKKDAPKDQDTNKPAVSSPKRVAASTTKLHSPGYPKQRTAAARNGFPPKPDPQAREAERQLVLRLKERCEQQTRQLGVAQGELKRAICGFDALAVATQHFFRKNESALVKEKELSIELANIRDEVAFHTAKCEKLQKEKEELERRFEDEVKRLGWQQQAELQELEERLQLQFEAEMARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 28844 - protein, 348 aa, Homo sapiens
MGHCCCKPYNCLQCLDKTNESALVKEKELSIELANIRDEVAFHTAKCEKLQKEKEELERRFEDEVKRLGWQQQAELQELEERLQLQFEAEMARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 28845 - protein, 2556 aa, Homo sapiens
MCAPSRSPVPEKAPKVLWTLSNEINLDSQLSNAPWTVIKRLRSPVNGGKNEWILYCASGVCGDLIITIGVEAVGEVEIGMRRTVLSSKRNKKVPAISAAKGLDAYKTSEDILEHYGDGRASSPIQPEQQKLFFPLLLPSTTSVSASNRQALTHIQNSNHEHLQEASRVTNSYSRQVFTNPQGRVGLSSFTEGDCNVADPWGCGGKPRSLEEQVGFLHLELEGSVFQCLRQLWLGEPFASPTGTSVHGWTRPDLAGSGLAGGGPGGISRDRTGPTPRAPEACVPTGPGGGTMMPGETHSAAPGTAADLSRCQGCASLQQNLNEYVEALITLKQKIINTDNLLTEYQKKCDELQFARRENSNLHHQVEEMLQKISPLQKCQEELGSLKAELEEKKSSLKLYQDTHQEYARVKEECLKSDAQKKKLEAKVKKLQEAAVKQTQDFKQLRNEKKILEKEFKKTQERLDEFSKQKNEKELRHIGTQISSDSYGSIDKRKVKLLLKELWLCVNTTHRLPGEGSRCVPEKPAKAITSSRVPGEDGTLPPTQGSPLRTSNVQTCLTKLSMEIKEDFLCQNVEKQSSSGTNCSSDHVFNENGNLEVLVQSHRDGGSTEFVDHDHFFDEDLQAAIDFFKLPPPLLSPVPSPPPMSSPHPGSLPSSFAPETYFGEYTDSSDNDSVQLRNSAECVSEDDTTESQNYFGSLRKNKGSGTWEEKPKSHEAIQALNTWEVNKVTTSGLETFTATLRESSATHSLVGEKHWTTASRSMSDRKRDILHETKTQMEVREMDKSVQTEKTIHKLTRGLCIERLSASPAQEKEAAPGKSELCSSPLGKRPLNELMESEGKTVLSKMMGSPKSEFTKWTRINEITSEPDRITVSGHFHRLSRELEKEKEDTQGFTLGESPESEDDDSGDGMDVAGLDIETSFSSSSTLVALSVGSNPQSSSGLDCGNDTDITTKVFSTEPHHSEHKLQTKTLNTLHLQSEPPECSIGGNNLENSLCALSPELGASNFNDQKSSGIEYTKVVKGLTKIHSLPRSVFMKATKDGQCESQDPRIELTLNKPDFTSLIGSQAALIKSGLGFVKSTSWHHSDLLRKGGEESLRAKSEHEQKTSHQLQKAMPFLQNRGPTPKPDLLRENNNPVEFKTTASVLPNQVSVITKQTRPEKVQSAKLEHLRPHRVEPTLVTENSGNKTGMSTVAKCDGERDDTTQNITEVAAVKSISPEVSASRRKLDFNSPGGSSPVENSDCSTNSRLSFSPENILIQNQDIVREAAVQGDGQKQRQPQATDLDSSGTHGSEMLPATEVTVSGGFSVEETSCGDTGRSGGEALAVANDSTSTPQNANGLWKLKSTTPGGALPECFGTTDTTFSSAFCRKHGETQDTSQSSLPGTLHCYTGIREGGDDTEVESEAFSCSEGSEQQDAPDDSQKNLGDTDAAVAEVRPSLEVGYLTSALQDFNISTFSELDRLSTSEVVMFLESCQLGDYSSGDSVSECSSKGTLSKEMNKELKASEIGEKYRKQPCEEETLGTCEEWIESEEDDYSLKNTSQLTQCSLETLSEVLTKIRQELQTNSEDCNGKDTGSLLLLNVNNNMTTENLKEKSPFRETTGSSSHASEPTPQAAALDTEGSSPISGMPQNENPQSRPEARSDAGRQTDGGEEDLPEPVEPSALCSDSVMEPSIEQSSNCEAETTFQCQIATVTSEVINVLINKDQNLVIEKGDNWTIISGVAVLPHVDQVTLCDIPGDIPISQDQGELEAGCIPVTSAEKSPEASHTGPAFQEAPCGNNLSCPQEDVSSSGQSTNFDKSRLRNRPVKPSIWISSQIYDQNFETQIVASDHTYYNSKLEPSGKNKNRSKISNKDQSNKPVKTSASSRVETHQSEVAQSFSGEKANTKTQRSQTQTILANADTSTPTDCSPDTLSKIRQEVGPPLPPLLAPLIATPPRTSQPLSPLISSSSPSSPASPVGQVSPFRETPVPPAMSPWPEDPRRASPPDPSPSPSAASASERVVPSPLQFCAATPKHALPVPGRLPPCASGHAAVGGPQENSVKILDTMYPELSARARTLNILKGNIQLTRGPPADCKNLPGPASAMIGFKTITSAATAFVKTGSSSGGDCNQDKSRDLGTQQDSSGKRTLSTSTLRSAKRLRLDTGSPEPETRGVTAEGIHKNLPGNLPPAEVATTNEERSCSSPAVSAVSQLPLSPKETVESHDKAIANALKKIAEFSFDLLPVIRSHVYVGNISKKPVMRDQEKEVVYEFSTTKKHLAECLLHSILSELKIQKISMDHNYIHALCRVYVGICRQLGDLERARLFCYSLLKEDFPESEKLTLFIANMWHDIFLSQSVINKAMQLVARQRAKGEVLNCLRAFLNWEKNAPVDVGFMVSKLLLTIQLCPKTEFQPSEKFGEDLSDNTWEYIFAIDLLCCHQKWIWTHDNIISKELWPVMDKWIKYRKGHANIAYTPDIIIASILRLIGRLGQLGLKEGFPSAVKNISSVIGMFIQHAHDEDIPWGIQLAAVYALCDLSPSNPAEISKILEAWRREASKSVPSAIVSCLEEVSALSTEELG

SEQ ID NO: 28846 - protein, 2659 aa, Homo sapiens [sequence omitted]

SEQ ID NO: 28847 - protein, 585 aa, Homo sapiens [sequence omitted]

SEQ ID NO: 28848 - protein, 585 aa, Homo sapiens [sequence omitted]

SEQ ID NO: 28849 - protein, 834 aa, Homo sapiens
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIDILNNLESCDLEDDDLMLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPGGYSAPSFSPWQGSFQGIPRTVPPHRRQTSSTTAFQQPSQTHRSHPGKTNKATTYRGPQ

SEQ ID NO: 28850 - protein, 456 aa, Homo sapiens
MDSRLQEIRERQKLRRQLLAQQLGAESADSIGAVLNSKDEQREIAETRETCRASYDTSAPNAKRKYLDEGETDEDKMEEYKDELEMQQDEENLPYEEEIYKDSSTFLKGTQSLNPHNDYCQHFVDTGHRPQNFIRDVGLADRFEEYPKLRELIRLKDELIAKSNTPPMYLQADIEAFDIRELTPKFDVILLEPPLEEYYRETGITANEKCWTWDDIMKLEIDEIAAPRSFIFLWCGSGEGLDLGRVCLRKWGYRRCEDICWIKTNKNNPGKTKTLDPKAVFQRTKEHCLMGIKGTVKRSTDGDFIHANVDIDLIITEEPEIGNIEKPVEIFHIIEHFCLGRRRLHLFGRDSTIRPGWLTVGPTLTNSNYNAETYASYFSAPNSYLTGCTEEIERLRPKSPPPKSKSDRGGGAPRGGGRGGTSAGRGRERNRSNFRGERGGFRGGRGGAHRGGFPPR

SEQ ID NO: 28851 - protein, 1639 aa, Homo sapiens
MAKDSPSPLGASPKKPGCSSPAAAVLENQRRELEKLRAELEAERAGWRAERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQAENKQLRRAGCPYQADEKVKRLKVKRAELTGLARRLADRARKLQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGAQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELEDGRRGLVPSNFVEQIPDSYIPGCLPAKSPDLGPSQLPAGQDEALEEDSLLSGKAQGVVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRARVEVRLPRDLLQVYWGTMSSTVTFDTLLAGPPYPPLDVLVERHASPGVLVVSWLPVTIDSAGSSNGVQVTGYAVYADGLKVCEVADATAGSTLLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCSQHMGTSKSPAPGFIHLRTECGPRKEPCQEKAALERVLRQKQDAQGFTPPQLGASQQYASDFHNVLKEEQEALCLDLWGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGNLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 28852 - protein, 428 aa, Homo sapiens
MGGLFSRWRTKPSTVEVLESIDKEIQALEEFREKNQRLQKLWVGRLILYSSVLYLFTCLIVYLWYLPDEFTARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 28853 - protein, 923 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 28854 - protein, 923 aa, Homo sapiens; identical to SEQ ID NO: 28853

SEQ ID NO: 28855 - protein, 1056 aa, Homo sapiens
MASQPNSSAKKKEEKGKNIQVVVRCRPFNLAERKASAHSIVECDPVRKEVSVRTGGLADKSSRKTYTFDMVFGASTKQIDVYRSVVCPILDEVIMGYNCTIFAYGQTGTGKTFTMEGERSPNEEYTWEEDPLAGIIPRTLHQIFEKLTDNGTEFSVKVSLLEIYNEELFDLLNPSSDVSERLQMFDDPRNKRGVIIKGLEEITVHNKDEVYQILEKGAAKRTTAATLMNAYSSRSHSVFSVTIHMKETTIDGEELVKIGKLNLVDLAGSENIGRSGAVDKRAREAGNINQSLLTLGRVITALVERTPHVPYRESKLTRILQDSLGGRTRTSIIATISPASLNLEETLSTLEYAHRAKNILNKPEVNQKLTKKALIKEYTEEIERLKRDLAAAREKNGVYISEENFRVMSGKLTVQEEQIVELIEKIGAVEEELNRVTELFMDNKNELDQCKSDLQNKTQELETTQKHLQETKLQLVKEEYITSALESTEEKLHDAASKLLNTVEETTKDVSGLHSKLDRKKAVDQHNAEAQDIFGKNLNSLFNNMEELIKDGSSKQKAMLEVHKTLFGNLLSSSVSALDTITTVALGSLTSIPENVSTHVSQIFNMILKEQSLAAESKTVLQELINVLKTDLLSSLEMILSPTVVSILKINSQLKHIFKTSLTVADKIEDQKKELDGFLSILCNNLHELQENTICSLVESQKQCGNLTEDLKTIKQTHSQELCKLMNLWTERFCALEEKCENIQKPLSSVQENIQQKSKDIVNKMTFHSQKFCADSDGFSQELRNFNQEGTKLVEESVKHSDKLNGNLEKISQETEQRCESLNTRTVYFSEQWVSSLNEREQELHNLLEVVSQCCEASSSDITEKSDGRKAAHEKQHNIFLDQMTIDEDKLIAQNLELNETIKIGLTKLNCFLEQDLKLDIPTGTTPQRKSYLYPSTLVRTEPREHLLDQLKRKQPELLMMLNCSENNKEETIPDVDVEEAVLGQYTEEPLSQEPSVDAGVDCSSIGGVPFFQHKKSHGKDKENRGINTLERSKVEETTEHLVTKSRLPLRAQINL

SEQ ID NO: 28856 - protein, 1388 aa, Homo sapiens
MAPGCKTELRSVTNGQSNQPSNEGDAIKVFVRIRPPAERSGSADGEQNLCLSVLSSTSLRLHSNPEPKTFTFDHVADVDTTQESVFATVAKSIVESCMSGYNGTIFAYGQTGSGKTFTMMGPSESDNFSHNLRGVIPRSFEYLFSLIDREKEKAGAGKSFLCKCSFIEIYNEQIYDLLDSASAGLYLREHIKKGVFVVGAVEQVVTSAAEAYQVLSGGWRNRRVASTSMNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 28857 - protein, 673 aa, Homo sapiens
MASQFCLPESPCLSPLKPLKPHFGDIQEGIYVAIQRSDKRIHLAVVTEINRENYWVTVEWVEKAVKKGKKIDLETILLLNPALDSAEHPMPPPPLSPLALAPSSAIRDQRTATKWVAMIPQKNQTASGDSLDVRVPSKPCLMKQKKSPCLWEIQKLQEQREKRRRLQQEIRARRALDVNTRNPNYEIMHMIEEYRRHLDSSKISVLEPPQEHRICVCVRKRPLNQRETTLKDLDIITVPSDNVVMVHESKQKVDLTRYLQNQTFCFDHAFDDKASNELVYQFTAQPLVESIFRKGMATCFAYGQTGSGKTYTMGGDFSGTAQDCSKGIYALVAQDVFLLLRNSTYEKLDLKVYGTFFEIYGGKVYDLLNWKKKLQVLEDGNQQIQVVGLQEKEVCCVEEVLNLVEIGNSCRTSRQTSVNAHSSRSHAVFQIILKSGGIMHGKFSLVDLAGNERGADTTKASRKRQLEGAEINKSLLALKECILALGQNKPHTPFRASKLTLVLRDSFIGQNSSTCMIATISPGMTSCENTLNTLRYANRVKKLNVDVRPYHRGHYPIGHEAPRMLKSHIGNSEMSLQRDEFIKIPYVQSEEQKEIEEVETLPTLLGKDTTISGKGSSQWLENIQERAGGVHHDIDFCIARSLSILEQKIDALTEIQKKLKLLLADLHVKSKVE

SEQ ID NO: 28858 - protein, 725 aa, Homo sapiens
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMLDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 28859 - protein, 673 aa, Homo sapiens
MDPQRSPLLEVKGNIELKRPLIKAPSQLPLSGSRLKRRPDQMEDGLEPEKKRTRGLGATTKITTSHPRVPSLTTVPQTQGQTTAQKVSKKTGPRCSTAIATGLKNQKPVPAVPVQKSGTSGVPPMAGGKKPSKRPAWDLKGQLCDLNAELKRCRERTQTLDQENQQLQDQLRDAQQQVKALGTERTTLEGHLAKVQAQAEQGQQELKNLRACVLELEERLSTQEGLVQELQKKQVELQEERRGLMSQLEEKERRLQTSEAALSSSQAEVASLRQETVAQAALLTEREERLHGLEMERRRLHNQLQELKGNIRVFCRVRPVLPGEPTPPPGLLLFPSGPGGPSDPPTRLSLSRSDERRGTLSGAPAPPPRHDFSFDRVFPPGSGQDEVFEEIAMLVQSALDGYPVCIFAYGQTGSGKTFTMEGGPGGDPQLEGLIPRALRHLFSVAQELSGQGWTYSFVASYVEIYNETVRDLLATGTRKGQGGECEIRRAGPGSEELTVTNARYVPVSCEKEVDALLHLARQNRAVARTAQNERSSRSHSVFQLQISGEHSSRGLQCGAPLSLVDLAGSERLDPGLALGPGERERLRETQAINSSLSTLGLVIMALSNKESHVPYRNSKLTYLLQNSLGGSAKMLMFVNISPLEENVSESLNSLRFASKVNQCVIGTAQANRK

SEQ ID NO: 28860 - protein, 406 aa, Homo sapiens
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRLSLEAVICFKEMLANSWNCLPKHLLHSVNQRFGSNNTSGS

SEQ ID NO: 28861 - protein, 708 aa, Homo sapiens
MAAAAVAAAAAAAAAASLQVLEMESMETAAAGSAGLAAEVRGSGTVDFGPGPGISAMEASGGDPGPEAEDFECSSHCSELSWRQNEQRRQGLFCDITLCFGGAGGREFRAHRSVLAAATEYFTPLLSGQFSESRSGRVEMRKWSSEPGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWVQRNAEERERYFEELFKLLRLSQMKPTYLTRHVKPERLVANNEVCVKLVADAVERHALRAENIQSGTCQHPTSHVSLLPRYGQNMDVIMVIGGVSEGGDYLSECVGYFVDEDRWVNLPHIHNHLDGHAVAVTESYVYVAGSMEPGFAKTVERYNPNLNTWEHVCSLMTRKHSFGLTEVKGKLYSIGGHGNFSPGFKDVTVYNPELDKWHNLESAPKILRDVKALAIEDRFVYIAARTPVDRDTEDGLKAVITCYDTETRQWQDVESLPLIDNYCFFQMSVVNSNFYQTASCCPKSYCLENEEAVRKIASQVSDEILESLPPEVLSIEGAAICYYKDDVFIIGGWKNSDDIDKQYRKEAYRYCAERKRWMLLPPMPQPRCRATACHVRIPYRYLHGTQRYPMPQNLMWQKDRIRQMQEIHRHALNMRRVPSSQIEC

SEQ ID NO: 28862 - protein, 539 aa, Homo sapiens
MDAMASPGKDNYRMKSYKNKALNPQEMRRRREEEGIQLRKQKREEQLFKRRNVYLPRNDESMLESPIQDPDISSTVPIPEEEVVTTDMVQMIFSNNADQQLTATQKFRKLLSKEPNPPIDQVIQKPGVVQRFVKFLERNENCTLQFEAAWALTNIASGTFLHTKVVIETGAVPIFIKLLNSEHEDVQEQAVWALGNIAGDNAECRDFVLNCEILPPLLELLTNSNRLTTTRNAVWALSNLCRGKNPPPNFSKVSPCLNVLSRLLFSSDPDVLADVCWALSYLSDGPNDKIQAVIDSGVCRRLVELLMHNDYKVVSPALRAVGNIVTGDDIQTQVILNCSALPCLLHLLSSPKESIRKEACWTVSNITAGNRAQIQAVIDANIFPVLIEILQKAEFRTRKEAAWAITNATSGGTPEQIRYLVALGCIKPLCDLLTVMDSKIVQVALNGLENILRLGEQESKQNGIGINPYCALIEEAYGLDKIEFLQSHENQEIYQKAFDLIEHYFGVEEDDPSIVPQVDENQQQFIFQQQEAPMDGFQL

SEQ ID NO: 28863 - protein, 395 aa, Homo sapiens
MVSAAGLSGDGKMRGVLLVLLGLLYSSTSCGVQKASVFYGPDPKEGLVSSMEFPWVVSLQDSQYTHLAFGCILSEFWVLSIASAIQNRKDIVVIVGISNMDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 28864 - protein, 296 aa, Homo sapiens
MDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 28865 - protein, 395 aa, Homo sapiens [sequence omitted]

SEQ ID NO: 28866 - protein, 296 aa, Homo sapiens [sequence omitted]

SEQ ID NO: 28867 - protein, 534 aa, Homo sapiens
MKQPNRKRKLNMDSKERLDQDGRLEQAEEEKKPKDSTTPLSHVPSAAAQGAWSWEWYLKEQKAVAAPVELFSKDQSFPEHENGFQIGMRLEGIDPRHPSVFCVLSVAEVCGYRLRLHFDGYLSCYDFWTNAGSPDIHPVGWCEKTKHELHIPKGYRKDKFVWMDYLKACKLQNAPKKLFRNRSPNGPMSKEFQVGMKLEAVDRKNPSLVCVATIADIVEDRLLVHFDNWDDSYDYWCDVNSPYVQPVGWCQENGRTLIAPQGYPNPENFSWTEYLEATQTNAVPAKVFKMRLPHGFLPNMKLEVVDKRNPRLIRVATIVDVDDQRVKVHFDGWDHKYDYWVEADSPDIHPIGWCDVTGHPLEVPQRTNDLKILPGQAVCPTPGCRGIGHIRGPRYSGHHSAFGCPYSDMNLKKEATLHDRLREQTQANLESDSSHSKSKSLCSLNFNGKHEKVNSQPRLVQQAKCLKIKGKEDIDLDNLFRGRVRWLMPVIPALWEAEAGRSRDQEIKTILANAVKPRLYQKYKKLARRGGGCL

SEQ ID NO: 28868 - protein, 233 aa, Homo sapiens
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLDQLPDFPYKDDLLALDSSCLLFIVLVFFALFIIFKAYLINCVWNCYKYINNRNVPEIAVYPAFEAPPQYVLPTYEMAVKMPEKEPPPPYLPA

SEQ ID NO: 28869 - protein, 332 aa, Homo sapiens
MATIKSELIKNFAEEEAIHHNKISIVGTGSVGVACAISILLKGLSDELVLVDVDEGKLKGETMDLQHGSPFMKMPNIVSSKDYLVTANSNLVIITAGARQKKGETRLDLVQRNVSIFKLMIPNITQYSPHCKLLIVTNPVDILTYVAWKLSGFPKNRVIGSGCNLDSARFRYFIGQRLGIHSESCHGLILGEHGDSSVPVWSGVNIAGVPLKDLNPDIGTDKDPEQWENVHKKVISSGYEMVKMKGYTSWGISLSVADLTESILKNLRRVHPVSTLSKGLYGINEDIFLSVPCILGENGITDLIKVKLTLEEEACLQKSAETLWEIQKELKL

SEQ ID NO: 28870 - protein, 381 aa, Homo sapiens
MSWTVPVVRASQRVSSVGANFLCLGMALCPRQATRIPLNGTWLFTPVSKMATVKSELIERFTSEKPVHHSKVSIIGTGSVGMACAISILLKGLSDELALVDLDEDKLKGETMDLQHGSPFTKMPNIVCSKDYFVTANSNLVIITAGARQEKGETRLNLVQRNVAIFKLMISSIVQYSPHCKLIIVSNPVDILTYVAWKLSAFPKNRIIGSGCNLDTARFRFLIGQKLGIHSESCHGWILGEHGDSSVPVWSGVNIAGVPLKDLNSDIGTDKDPEQWKNVHKEVTATAYEIIKMKGYTSWAIGLSVADLTESILKNLRRIHPVSTIIKGLYGIDEEVFLSIPCILGENGITNLIKIKLTPEEEAHLKKSAKTLWEIQNKLKL

SEQ ID NO: 28871 - protein, 334 aa, Homo sapiens
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDDEVAQLKKSADTLWDIQKDLKDL

SEQ ID NO: 28872 - protein, 108 aa, Homo sapiens
MVDVKCLSDCKLQNQLEKLGFSPGPILPSTRKLYEKKLVQLLVSPPCAPPVMNGPRELDGAQDSDDSEGGLQEHQAPESHMGLSPKRETTARKTRLSRAGEKKVSQWA

SEQ ID NO: 28873 - protein, 195 aa, Homo sapiens
MDPQSRSLKNAGSRSSSRENRATSGEGAQPCQGTDDGPSLGAQDQRSTPTNQKGSIIPNNIRHKFGSNVVDQLVSEEQAQKAIDEVFEGQKRASSWPSRTQNPVEISSVFSDYYDLGYNMRSNLFRGAAEETKSLMKASYTPEVIEKSVRDLEHWHGRKTDDLGRWHQKNAMNLNLQKALEEKYGENSKSKSSKY

SEQ ID NO: 28874 - protein, 231 aa, Homo sapiens
MGPPLWPDLQEPPPPGTSSQIRSPLLCDVIKPAPHHDVTVRVVPPPRFLPLLLRPLPSDGDIAMRRDRGPKPALGGAGEVEPGGMAASPTGRPRRLQRYLQSGEFDQFRDFPIFESNFVQVTRLGEVANEVTMGVAASSPALELPDLLLLAGPAKENGHLQLFGLFPLKFVQLFVHDKSRCQLEVKLNTSRTFYLQLRAPLKTRDREFGQWVRLLYRLRFLSASAVPFTQE

SEQ ID NO: 28875 - protein, 293 aa, Homo sapiens
MALVSADSRIAELLTELHQLIKQTQEERSRSEHNLVNIQKTHERMQTENKISPYYRTKLRGLYTTAKADAEAECNILRKALDKIAEIKSLLEERRIAAKIAGLYNDSEPPRKTMRRGVLMTLLQQSAMTLPLWIGKPGDKPPPLCGAIPASGDYVARPGDKVAARVKAVDGDEQWILAEVVSYSHATNKYEVDDIDEEGKERHTLSRRRVIPLPQWKANPETDPEALFQKEQLVLALYPQTTCFYRALIHAPPQRPQDDYSVLFEDTSYADGYSPPLNVAQRYVVACKEPKKK

SEQ ID NO: 28876 - protein, 357 aa, Homo sapiens
MSAFEKPQIIAHIQKGFNYTVFDCKWVPCSAKFVTMGNFARGTGVIQLYEIQHGDLKLLREIEKAKPIKCGTFGATSLQQRYLATGDFGGNLHIWNLEAPEMPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKAHKSTVWQVRHLPQNRELFLTAGGAGGLHLWKYEYPIQRSKKDSEGIEMGVAGSVSLLQNVTLSTQPISSLDWSPDKRGLCVCSSFDQTVRVLIVTKLNKI

SEQ ID NO: 28877 - protein, 315 aa, Homo sapiens
METSSKGLLTQVTQFWNLLDDLAQSDPEGYEKFIQQQLKEGKQLCAAPEPQLCLQTRILKPKEKILFINLCQWTRIPAPQSTTHPVPLTVGKPEDTTEISDAYTVIDVAYNPDVLHAAEKDQVKKNQLIQMAMKCIEEKFQFTLSHSYHITKFRIKGSIQRMKQNLMGIQTDSIDLREKMRRELTLGQIRSSTMSNPDHFPQLLLPKDQVSGKAVCLIEEISSTEIQVEMKMPAYELKIVHDHSEKPLKIELKVELPGINSVSLCDLSVSEDDLLIEVSEKYRLHLNLPKLIDTEMTTAKFIKEKSTLIITMPLV

SEQ ID NO: 28878 - protein, 1628 aa, Homo sapiens
MFFKMKNEIDNDPESEKCIKDSTIMRREPQNILSPLMLPNLEIPFSVKDIISRIERAQLHRAREDIDMQLSEIMNNVHRIMTRYTLVFNSSSERNVSLTEHKKKQRTNFLEKMATYAKTIEIREKTLANILAWLEEWNDVLSEMTLMDVDEHHHWIAQMELLPDTLKAIENNVKILSRFSTSFLDEKKKQKKKILSRGTLWKSWKERVIKRPSTARALRPDQMISDQLATNTKVSEIQGMLQELIGTTMFSTLENNAIKYISSTIVNLSTALSMLNDELKCVNFQSSTVYAHETSEAEKELSLKIIRDLSNENEMLQQKLQDAEEKCEQLIRSKIVIEQLYAKLSTSSTLKVLPGPSPQSSRAIIKVGDTEDNMDNILDKELENIVDEVQRKETKDSGIKWDSTISYTAQAERTPDLTELRQQPVASEDISEDSTKDNVSLKKGDFYQEDETDEYQSWKRSHKKATYVYETSGPNLSDNKSGQKVSEAKPSQYYELQVLKKKRKEMKSFSEDKSKSPTEAKRKHLSLTETKSQGGKSGTSMMMLEQFRKVKRESPFDKRPTAAEIKVEPTTESLDKEGKGEIRSLVEPLSMIQFDDTAEPQKGKIKGKKHHISSGTITSKEEKTEEKEELTKQVKSHQLVKSLSRVAKETSESTRVLESPDGKSEQSNLEEFQEAIMAFLKQKIDNIGKAFDKKTVPKEEELLKRAEAEKLGIIKAKMEEYFQKVAETVTKILRKYKDTKKEEQVGEKPIKQKKVVSFMPGLHFQKSPISAKSESSTLLSYESTDPVINNLIQMILAEIESERDIPTVSTVQKDHKEKEKQRQEQYLQEGQEQMSGMSLKQQLLGERNLLKEHYEKISENWEEKKAWLQMKEGKQEQQSQKQWQEEEMWKEEQKQATPKQAEQEEKQKQRGQEEEELPKSSLQRLEEGTQKMKTQGLLLEKENGQMRQIQKEAKHLGPHRRREKGKEKQKPERGLEDLERQIKTKDQMQMKETQPKELEKMVIQTPMTLSPRWKSVLKDVQRSYEGKEFQRNLKTLENLPDEKEPISITPPPSLQYSLPGALPISGQPLTKCIHLTPQQAQEVGITLTPQQAQAQGITLTLQQAQELGIPLTPQQAQALEILFTPQQAQALGIPLTPQQTQVQGITLTPQQDQAPGISLTTQQAQKLGIPLTPQQAQALGIPLTPQQAQELGIPLTPQQAQALRVSLTPQQAQELGIPLTPQQAQALGITLTLQQAQQLGIPLTPQQAQALGITLTPKQVQELGIPLTPQQAQALGITLTPKQAQELGIPLNPQQAQTLGIPLTPKQAQALGIPFTPQQAQALGIPLTPQQAQTQEITLTPQQAQALGMPLTTQQAQELGIPLTPQHAQALGMPLTTQQAQELGIPLTPQQAQALGMPLTTQQAQELGIPLTPQQAQELGIPFTPQQAQAQEITLTPQQAQALGMPLTAQQAQELGITLTPQQAQELGIPLTPQQAQALGIPLIPPQAQELGIPLTPQQAQALGILLIPPQAQELGIPLTPQQAQALGIPLIPPQAQELGIPLTPQQVQALGIPLIPPQAQELEIPLTPQQAQALGIPLTPQQAQELGIPLTPQQAQELGIPLTPQQAQAQGIPLTPQPRHWESPSPQ

SEQ ID NO: 28879 - protein, 1951 aa, Homo sapiens
MFFKMKNEIDNDPESEKCIKDSTIMRREPQNILSPLMLPNLEIPFSVKDIISRIERAQLHRAREDIDMQLSEIMNNVHRIMTRYTLVFNSSSERNVSLTEHKKKQRTNFLEKMATYAKTIEIREKTLANILAWLEEWNDVLSEMTLMDVDEHHHWIAQMELLPDTLKAIENNVKILSRFSTSFLDEKKKQKKKILSRGTLWKSWKERVIKRPSTARALRPDQMISDQLATNTKVSEIQGMLQELIGTTMFSTLENNAIKYISSTIVNLSTALSMLNDELKCVNFQSSTVYAHETSEAEKELSLKIIRDLSNENEMLQQKLQDAEEKCEQLIRSKIVIEQLYAKLSTSSTLKVLPGPSPQSSRAIIKVGDTEDNMDNILDKELENIVDEVQRKETKDSGIKWDSTISYTAQAERTPDLTELRQQPVASEDISEDSTKDNVSLKKGDFYQEDETDEYQSWKRSHTKGTYVYETSGPNLSDNKSGQKVSEAKPSQYYELQVLKKKRKEMKSFSEDKSKSPTEAKRKHLSLTETKSQGGKSGTSMMMLEQFRKVKRESPFDKRPTAAEIKVEPTTESLDKEGKGEIRSLVEPLSMIQFDDTAEPQKGKIKGKKHHISSGTITSKEEKTEEKEELTKQVKSHQLVKSLSRVAKETSESTRVLESPDGKSEQSNLEEFQEAIMAFLKQKIDNIGKAFDKKTVPKEEELLKRAEAEKLGIIKAKMEEYFQKVAETVTKILRKYKDTKKEEQVGEKPIKQKKVVSFMPGLHFQKSPISAKSESSTLLSYESTDPVINNLIQMILAEIESERDIPTVSTVQKDHKEKEKQRQEQYLQEGQEQMSGMSLKQQLLGERNLLKEHYEKISENWEEKKAWLQMKEGKQEQQSQKQWQEEEMWKEEQKQATPKQAEQEEKQKQRGQEEEELPKSSLQRLEEGTQKMKTQGLLLEKENGQMRQIQKEAKHLGPHRRREKGKEKQKPERGLEDLERQIKTKDQMQMKETQPKELEKMVIQTPMTLSPRWKSVLKDVQRSYEGKEFQRNLKTLENLPDEKEPISITPPPSLQYSLPGALPISGQPLTKCIHLTPQQAQEVGITLTPQQAQAQGITLTLQQAQELGIPLTPQQAQALEILFTPQQAQALGIPLTPQQTQVQGITLTPQQDQAPGISLTTQQAQKLGIPLTPQQAQALGIPLTPQQAQELGIPLTPQQAQALGVSLTPQQAQELGIPLTPQQAQALGITLTPQQAQQLGIPLTPQQAQALGITLTPKQVQELGIPLTPQQAQALGITLTPKQAQELGIPLNPQQAQTLGIPLTPKQAQALGIPFTPQQAQALGIPLTPQQAQTQEITLTPQQAQALGMPLTTQQAQELGIPLTPQHAQALGMPLTTQQAQELGIPLTPQQAQALGMPLTTQQAQELGIPLTPQQAQELGIPLTPQQAQAQEITLTPQQAQALGMPLTAQQAQELGITLTPQQAQELGIPLTPQQAQALGIPLIPPQAQELGIPLTPQQAQALGIPLIPPQAQELGIPLTPQQAQALGIPLIPPQAQELGIPLTPQQVQALGIPLIPPQAQELEIPLTPQQAQALGIPLTPQQAQELGIPLTPQQAQELGIPLTPQQAQAQGIPLTPQQAQALGISLTPQQAQAQGITLTPQQAQALGVPITPVNAWVSAVTLTSEQTHALESPMNLEQAQEQLLKLGVPLTLDKAHTLGSPLTLKQVQWSHRPFQKSKASLPTGQSIISRLSPSLRLSLASSAPTAEKSSIFGVSSTPLQISRVPLNQGPFAPGKPLEMGILSEPGKLGAPQTLRSSGQTLVYGGQSTSAQFPAPQAPPSPGQLPISRAPPTPGQPFIAGVPPTSGQIPSLWAPLSPGQPLVPEASSIPGDLLESGPLTFSEQLQEFQPPATAEQSPYLQAPSTPGQHLATWTLPGRASSLWIPPTSRHPPTLWPSPAPGKPQKMLQISR

SEQ ID NO: 28880 - protein, 195 aa, Homo sapiens
MAVSQGDGTLCFVLLLCCWQETELRPRTVIPGSPTEIPFSSKQEDMSELLDEILVQEILDLNKTTPSEMPSTASTLSTPLHAGIDENYQAGGSENYHELLENLQFSPGIEDKISNDEANANANLHGDPSENYRGPQVSPGSEKSVSSKEKNSKNTQYENLSILDQILQNIGRSSGNIFHKEQQRTSAQRRSQGSQ

SEQ ID NO: 28881 - protein, 555 aa, Homo sapiens
MDSVVFEDVAVDFTLEEWALLDSAQRDLYRDVMLETFRNLASVDDGTQFKANGSVSLQDMYGQEKSKEQTIPNFTGNNSCAYTLEKNCEGYGTEDHHKNLRNHMVDRFCTHNEGNQYGEAIHQMPDLTLHKKVSAGEKPYECTKCRTVFTHLSSLKRHVKSHCGRKAPPGEECKQACICPSHLHSHGRTDTEEKPYKCQACGQTFQHPRYLSHHVKTHTAEKTYKCEQCRMAFNGFASFTRHVRTHTKDRPYKCQECGRAFIYPSTFQRHMTTHTGEKPYKCQHCGKAFTYPQAFQRHEKTHTGEKPYECKQCGKTFSWSETLRVHMRIHTGDKLYKCEHCGKAFTSSRSFQGHLRTHTGEKPYECKQCGKAFTWSSTFREHVRIHTQEQLYKCEQCGKAFTSSRSFRGHLRTHTGEKPYECKQCGKTFTWSSTFREHVRIHTQEQLHKCEHCGKAFTSSRAFQGHLRMHTGEKPYECKQCGKTFTWSSTLHNHVRMHTGEKPHKCKQCGMSFKWHSSFRNHLRMHTGQKSHECQSYSKAFSCQVILSKTSESTH

SEQ ID NO: 28882 - protein, 182 aa, Homo sapiens
MAPASNFSAGSDWHGVGAAGAAPGQHLASCPVAPDGSSASGPHFLLSTGKPTPSEATRGKSEQGVPAVPTSQRHVLWPLTQPMRQSSDPRAHFPGHGAQPQPEPCEGRGTRMTTWGTMALHTWALYFSLENPGKILKQVHEVLSLCSKQHSSGVGTKGSTEPRPPQPLPGPICAVQVIHACS

SEQ ID NO: 28883 - protein, 361 aa, Homo sapiens
MATLARLQARSSTVGNQYYFRNSVVDPFRKKENDAAVKIQSWFRGCQVRAYIRHLNRIVTIIQKWWRSFLGRKQYQLTVQVAYYTMMMNLYNAMAVRIQRRWRGYRVRKYLFNYYYLKEYLKVVSETNDAIRKALEEFAEMKEREEKKANLEREEKKRDYQARKMHYLLSTKQIPGIYNSPFRKEPDPWELQLQKAKPLTHRRPKVKQKDSTSLTDWLACTSARSFPRSEILPPINRKQCQGPFRDITEVLEQRYRPLEPTLRVAEPIDELKLAREELRREEWLQNVNDNMFLPFSSYHKNEKYIPSMHLSSKYGPISYKEQFRSENPKKWICDKDFQTVLPSFELFSKYGKLYSKAGQIV

SEQ ID NO: 28884 - protein, 231 aa, Homo sapiens
MEKRRERIHNFLSELLKEKLDNEDMIIARDIAEAEAEWEKREREKDEKNKAELKTIAEYRAIVMKNKEEEERQRKIEAKEQLLAVMKADQIFWEHEKEKKCKADKEHQEVQDAHIQQMAKNKFNAKQAKQAELDYCRLTEALVAEKEKEFQDYAREVIELESETTNKYIYPLVKAVQEGPGGGRGPVFVDRGGLRPSYQANDVTGVQLPFYNSQGPKYNFQKSKRRLGFTW

SEQ ID NO: 28885 - protein, 231 aa, Homo sapiens; identical to SEQ ID NO: 28884

SEQ ID NO: 28886 - protein, 102 aa, Homo sapiens
MREIAEILPAQEKVEARIDLKMGKKRVTDHKLNVDKVIKNINTISSELKKIKELSQLLLCDLILHFNHPIKTENLAEAERNNPLFEESKISDVSLVSNSFSI

SEQ ID NO: 28887 - protein, 102 aa, Homo sapiens; identical to SEQ ID NO: 28886

SEQ ID NO: 28888 - protein, 102 aa, Homo sapiens; identical to SEQ ID NO: 28886

SEQ ID NO: 28889 - protein, 102 aa, Homo sapiens; identical to SEQ ID NO: 28886

SEQ ID NO: 28890 - protein, 244 aa, Homo sapiens
MGDLFSLFWEVDPPPIPVNCAIPNQDYECWKDDSCGTIGSFLLWYFVIVFVLMFFSRASVWMSEDKKDEGSGTSTSVRKASKETSCKRQSKDSAWDPSQTMKKPKQNQLTPVTNSEVALVNAYPEQRRARRQSQFNEVNQNQHDSDTTEYGSEESNSEASSWKESESEHHPSPDSIKRRKMAQRQRNLGSYQMSERHCLHCKALRTNEWLAHHSRQKPSVTPPMKRDSQEESSISDINKKFSKF

SEQ ID NO: 28891 - protein, 121 aa, Homo sapiens
MRNHFKFLSKKDKMAAARRRAWREGERAAGSLTRGLQLEPWHWQGAWRRKRRKTVSRQDHPNRSSKLPWTSLPCPHREAAGDRAYLGNTNHGSDTSEMSCRASASTLIQTLSFSELLQAPG

SEQ ID NO: 28892 - protein, 515 aa, Homo sapiens
MHTTESKNEHLEDENFQTSTTPQSLIDPNNTAHEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQAVLGPLALETARVSAPHLEPYAKDVMTVAFLAILITAPNGALLMGILGPKMLTRHYDPSKIKLQLSTLEHH

SEQ ID NO: 28893 - protein, 94 aa, Homo sapiens
MNYLHLIVFFSIGKLFRSEDLTHFVRFFLMFYKEKPIDWLLNDIFQVKVCDAGEDLRNCMKRKKQIRIQYKPSLFQHVGIHSSFPRKEQYEKKI

SEQ ID NO: 28894 - protein, 574 aa, Homo sapiens
MWPQPRFPPHPAMSEKTQQGKLAAAKKKLKAYWQRKSPGIPAGANRKKKINGSSPDTATSGGYHSPGDSATGIYGEGRASSTTLEDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLREQEERLREQEDRLHEQEERLREQEERLCEQEERLREHEERLCEQEERLCEQEERLREQEERLHEQEERLREQEERLCEQEERLREQEERLCEQEERLREQEERLCEQEKLPGQERLLEEVEKLLEQERRQEEQERLLERERLLEEVEKLLEQERQQEEQERLLERERLLEEVEKLLEQERRQEEQERLLERERLLDEVEELLDEVEELLEQERLRQQDERLWQQETLQELERLRELERLRELERMLELGWEALYEQRAEPRSGFEELNNENKSTLQLEQQVKELKKSGGAEEPRGSESAAAARPVAGAPVPQGAWMCGQAGWTPQEHPGLSGEAVGTGEAAGGAGEAACHSFRAAENRELNITII

SEQ ID NO: 28895 - protein, 345 aa, Homo sapiens
MLSLLNRRQEERLREQEERLREQEERLREQEDRLHEQEERLREQEERLCEQEERLREHEERLCEQEERLCEQEERLREQEERLHEQEERLREQEERLCEQEERLREQEERLCEQEERLREQEERLCEQEERLLEEVEKLLEQERQQEEQERLLERERLLEEVEKLLEQERRQEEQERLLERERLLDELLEQERLRQQDERLWQQETLQELERLRELERLRELERMLELGWEALYEQRAEPRSGFEELNNENKSTLQLEQQVKELKKSGGAEEPRGSESAAAARPVAGAPVPQGAWMCGQAGWTPQEHPGLSGEAVGTGEAAGGAGEAACHSFRAAENRELNITII

SEQ ID NO: 28896 - protein, 386 aa, Homo sapiens
MLSLLNRRQEERLREQEERLREQEERLREQEDRLHEQEERLREQEERLCEQEERLREHEERLCEQEERLCEQEERLREQEERLHEQEERLREQEERLCEQEERLREQEERLCEQEERLREQEERLCEQEKLPGQERLLEEVEKLLEQERRQEEQERLLERERLLEEVEKLLEQERQQEEQERLLERERLLEEVEKLLEQERRQEEQERLLERERLLDEVEELLDEVEELLEQERLRQQDERLWQQETLQELERLRELERLRELERMLELGWEALYEQRAEPRSGFEELNNENKSTLQLEQQVKELKKSGGAEEPRGSESAAAARPVAGAPVPQGAWMCGQAGWTPQEHPGLSGEAVGTGEAAGGAGEAACHSFRAAENRELNITII

SEQ ID NO: 28897 - protein, 146 aa, Homo sapiens
MHTTSYRRLSPPHLTDQPSAYSHTHRTFSHFSCGSQPAAQRLHVELWNADLQSEFLCPCLGLTLYLTCNPQLGKRKFCSHSSEDMSKMVSRRNVKDSHEVSGSLQATLQPRGITRIRGCFSLGHADRRRRRGWQPPVHSLPFFFRR

SEQ ID NO: 28898 - protein, 146 aa, Homo sapiens; identical to SEQ ID NO: 28897

SEQ ID NO: 28899 - protein, 64 aa, Homo sapiens
MADTLWIVTCWWAMKSIWGFESIILLIKQKRIICNKEPMDEYHLVLVIYCTESLKLLHTFLLRD

SEQ ID NO: 28900 - protein, 64 aa, Homo sapiens; identical to SEQ ID NO: 28899

SEQ ID NO: 28901 - protein, 205 aa, Homo sapiens
MATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNEIESHIIKQEDILNGKENEIKELQQVISQQKQIFRNHMSDFRIQKQQESYMAQVLDQKHKKASGTRQARSHQHPREK

SEQ ID NO: 28902 - protein, 205 aa, Homo sapiens; identical to SEQ ID NO: 28901

SEQ ID NO: 28903 - protein, 102 aa, Homo sapiens
MMFHATFYSCLHKSRKRKREHISPYLLISNSLLRGQDYLQGKKRGMPSPPSRSYVPVPEHLFPSTLKRSKCFASNSQIIYSQGEKCFKTEVLNGIKYCQQTK

SEQ ID NO: 28904 - protein, 102 aa, Homo sapiens; identical to SEQ ID NO: 28903

SEQ ID NO: 28905 - protein, 131 aa, Homo sapiens
MAFFNLYLLGYQNSFQNKKRNTTEETNQKEPEPTRLPPIISKDGNYSVHQNSHTRYHEAVRKVLLKTFPNQVFRIPLTDAQNFSFWWSHDPGVRPEETMPWIRSPRHCLIKSAMTRFMDHSILNDRTFSLY

SEQ ID NO: 28906 - protein, 119 aa, Homo sapiens
MVAHACNPRTLEARDQKEPEPTRLPPIISKDGNYSVHQNSHTRYHEAVRKVLLKTFPNQVFRIPLTDAQNFSFWWSHDPGVRPEETMPWIRSPRHCLIKSAMTRFMDHSILNDRTFSLY

SEQ ID NO: 28907 - protein, 131 aa, Homo sapiens; identical to SEQ ID NO: 28905

SEQ ID NO: 28908 - protein, 119 aa, Homo sapiens; identical to SEQ ID NO: 28906

SEQ ID NO: 28909 - protein, 286 aa, Homo sapiens
MRTPYTTSLTRTPHTTSLTRILYTTSLTRPPTRASPTRMPPRASPTRTPPRASPRRTPPRASPRRTPPRASLTRPPTRAPPTRMPPTAPPTRTPPTASPARTPPTESPARTPPTASPARTPPRASPTRTPPRASPRRTPSTASPTRTPPRASPRRTPPRASPTRTPPRASPKRTPPRASPRRTPPRASPTRAPPRASPKRTPPTASPTRTPPRASPTRTPPTESPARTPPRASPTRTPPTESPARTPSRASTRRTPPRASPTRTPPRASPKRTPPTASPTSCIRHR

SEQ ID NO: 28910 - protein, 396 aa, Homo sapiens
MEAERLRLLEEEAKLKKVARMGFNASSMLRKSQLGFLNVTSYSRLANELRVSCMERKKVQIRSLDPSSLASDRFNFILASTNSDQLFVVNQVEVEGSKYGIISLRTLKIPSFHVYVLRNLYVPNRKVKSLCWASLNQLDSHVLLCFEGITDAPSCAVLLPASRFLSVHTRVNQPGMLCSFQIPEAWSCAWSLNTWAYHCFSAGLSQQVLLTSVATGHQQSFDTSSDVLAQQFASTAPLLFNGCRSGEIFAIDLRCRNRGKGWRATRLFHDSAVTSVQILQEEQCLMASDMTGKIKLWDLRATKCVRQYEGHVNESAYLPLHVHEEEGIVVAVGQDCYTRIWSLHDAHLLRTIPSPYSASEDDIPSVAFASRLGGIRGAAPGLLMAVRQDLYCFPFS

SEQ ID NO: 28911 - protein, 107 aa, Homo sapiens
MLSKGRSPRRKQVQTQRKAALVLSVTPMVPVGSVWLAMSSVLSAFMRELPGWFLFFGVFLPVTLLLLLLIAYFRIKLIEVNEELSQNCDRQHNPKDGSSLYQRMKWT

SEQ ID NO: 28912 - protein, 107 aa, Homo sapiens; identical to SEQ ID NO: 28911

SEQ ID NO: 28913 - protein, 99 aa, Homo sapiens
MCSVRIRMFNCVKVGDGKIGIMAWIQKSVFHYRKWEFKDDQKTVGSRVRIRTLNCCLTFQITKKFFTMSRTLNLKAEWIESLQRGSGMVFDVGKGNMYF

SEQ ID NO: 28914 - protein, 114 aa, Homo sapiens
MYTSLKSTFVAFADGRGTTESMPSPPLANSNHESPVNQLGNMQNMRLGPSFILTGIFLGNGRTEASPFFTDEFALSKIFPEYKRNLFGKFQTNMAFSLELDPPSLLLSVVLFMF

SEQ ID NO: 28915 - protein, 314 aa, Homo sapiens [sequence omitted]

SEQ ID NO: 28916 - protein, 314 aa, Homo sapiens [sequence omitted]

SEQ ID NO: 28917 - protein, 135 aa, Homo sapiens
MAGHPKERVVTDEVHQNQILRELYLKELRTQKLHTQYHVNPLRKVHRITRKPMSWHDNLEEPADARFLNLIHHAAQGPTKKYPEAQTENQEIGWDSEALVDPERRDHRMNHFRVYSDITLYKAKMWSLGEDDRHK

SEQ ID NO: 28918 - protein, 135 aa, Homo sapiens; identical to SEQ ID NO: 28917

SEQ ID NO: 28919 - protein, 135 aa, Homo sapiens; identical to SEQ ID NO: 28917

SEQ ID NO: 28920 - protein, 142 aa, Homo sapiens
MLPLLDSSKRAGTLGSGCGVPRVHSAALSREEGASRDIWRIKVWARVMTTPAGSGSGFGSVSWWGLSPALDLQAESPPVDPDSQADTVHSNPELDVLLLGSVDGRHLLRTLSRAKFWPRRRFNVSWDEDESPDSRVLEGGRD

SEQ ID NO: 28921 - protein, 588 aa, Homo sapiens
MLPLLDSSKRAGTLGSGCGVPRVHSAALSREEGASRDIWRIKVWARVMTTPAGSGSGFGSVSWWGLSPALDLQAESPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 28922 - protein, 172 aa, Homo sapiens
MPVGAGLPTSLTSPPSTEAPKSSLLRKQTQPPKKQSSPAVHLRCTMDPVMMTVSPPPAHRHRRRGSPTRCAHCPVAWAPDTDDEKPHQYPAICSYHWDVPEDWEGFQHTQGTWVPWSQDAPESPPQTIRFQPGQQSETPSQKKKKKKKKRNIGAPLKRYLTVTSQLSVTSLL

SEQ ID NO: 28923 - protein, 260 aa, Homo sapiens
MPNSQNPVTSPLENKGPGHSGDSDWLGRWADWLGRWVGEFPLPRAIGQVPKLSCMDSQQEDLRFPGMWVSLYFGILGLCSVITGGCIIFLHWRKNLRREEHAQQWVEVMRAATFTYSPLLYWINKRRRYGMNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 28924 - protein, 260 aa, Homo sapiens
MPNSQNPVTSPLENKGPGHSGDSDWLGRWADWLGRWVGEFPLPRAIGQVPKLSCMDSQQEDLRFPGMWVSLYFGILGLCSVITGGCIIFLHWRKNLRREEHAQQWVEVMRAATFTYSPLLYWINKRRRYGMNAAINTGPAPAVTKTETEVQNPDVLWELDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 28925 - protein, 102 aa, Homo sapiens [sequence omitted]

SEQ ID NO: 28926 - protein, 131 aa, Homo sapiens
MGPAVLGQGQEGQPEARACSGLLQPPKRPIVFKEKLTMKTDSLMEEKLECSLWCCLSDPSIPGRCCVLERRIVPWMQQESYSSSSPIWSVDSDEPNLTSVLERLEDTKENSSVRKETKLFSLFLMNIIFRN

SEQ ID NO: 28927 - protein, 434 aa, Homo sapiens
MEWKLEQSMREQALLKAQLTQLKESLKEVQLERDEYAEHLKGERARWQQRMRKMSQEVCSLKKEKKHDKYRVEKLERSLSKLKNQMAEPLPPEPPAVPSEVELQHLRKELERVAGALQAQVEYNQRISLLNEGQKERLREQEERLQEQQERLPEQEERLQQLAEPQNSFKELNNENKSVLQLEQQVKELQEKLGKVKETERLEAASQQKQQLTAQLSLMALPGEGHGGEHLDSEGEEAPRPMPSVPEDLESREAMSGFMDHLEEKADLSELVEKEELGFFQYYREGCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQVEAREGSPHDNPTAQPIVQDHQEHPGLGSNCCVPFFCWAWLPRRRR

SEQ ID NO: 28928 - protein, 430 aa, Homo sapiens
MEWKLEQSMREQALLKAQLTQLKESLKEVQLERDEYAEHLKGERARWQQRMRKMSQEVCSLKKEKKHDKYRVEKLERSLSKLKNQMAEPLPPEPPAVPSEVELQHLRKELERVAGALQAQVEYNQRISLLNEGQKERLREQEERLQEQQERLPEQEERLQQLAEPQNSFKELNNENKSVLQLEQQVKELQEKLGKERLEAASQQKQQLTAQLSLMALPGEGHGGEHLDSEGEEAPRPMPSVPEDLESREAMSGFMDHLEEKADLSELVEKEELGFFQYYREGCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQVEAREGSPHDNPTAQPIVQDHQEHPGLGSNCCVPFFCWAWLPRRRR

SEQ ID NO: 28929 - protein, 213 aa, Homo sapiens
MIQGQAQSSCKNLKQMVSTKHFTKKYSSCSTIYLDDSTASQPHLTIIVKSNELERQFLQLIDYNVEVSGSVYAKYYFDLRSLAKDNSLHFPVYLLNKERAQNLEAISRMEDAKIFYSEGPSALIISLIFSALKPLTLEGRNEGLYHVNPSSKKFGKYYLSCSTTRKVSIFKRRKISKLRGLWATRIALHRKKMGSLQCNNSRTLFCLFKRKQV

SEQ ID NO: 28930 - protein, 213 aa, Homo sapiens; identical to SEQ ID NO: 28929

SEQ ID NO: 28931 - protein, 397 aa, Homo sapiens [sequence omitted]

SEQ ID NO: 28932 - protein, 216 aa, Homo sapiens
MPTERILNLYGKNYKPQDQSPPSPQRDSGLTPERDRPDWPRSFKPPLSPEKGTKASGPQTSAPSPRDPGLHTPPCSPRRGRRGRPTQEVCPAPGPCAQPAGTCPPPPTGEKQPRPHGFRCSHGSKRAPALLGAPARRPPAHIPAQPRWPRLQPVAKRRARPVPPGLPGAPKQAALTPGRRPLTPAAFAPKASRDQQMGPLRCKEFNLSQVTQFGRG

SEQ ID NO: 28933 - protein, 216 aa, Homo sapiens; identical to SEQ ID NO: 28932

SEQ ID NO: 28934 - protein, 151 aa, Homo sapiens
MAASSQGNFEGDIESVDLAEFAKQQPWWRKLFGPESGLSAEKYSVATHLFIGGVTGWCTGFIFQKVGKLAATAVGGGFFLLQLANHSGYIKVDWQRVEKDMKKAKEQLKIPKSTQIPNQVRSKAEEVVSFVKKNVLVTGGFFGGFLLGMAS

SEQ ID NO: 28935 - protein, 230 aa, Homo sapiens [sequence omitted]

SEQ ID NO: 28936 - protein, 556 aa, Homo sapiens
MHPMALHMVLPAHLPFLSPEVLRLLEVHVKKWMHFQRWGLPRRVEESLRQLMPNPPLYYQPGNDQPVSFNLNNTSQVSLHRSETISLQTWCSCVAGQPIQTFWVSEWSTMNPEQRHHCQQTPNPMALALPSPALKALSGPHPQSGGQDNDSGSDLQQKYSQLFCGLPSLHSESLVATFMGSQGLPKIENVPKPPLKDPFLFNELSFPQLLPKTSPQSAPPSSPLSPNWVSPSDHQRAQINVPFLTLAEYEALEWHLLQRQLQLQWGWPAALQRSQHTQCLMQHEPCGKAQSPETTTASQTGKSISVLTRELLFFPEHARKLLEFHIQKQSIRHRWGLPQKIQQSIQLLLTSTDQQTVSSSSTALANVSIPQPVALEANGACDVLSPIAAPVSIPRPHLLTQVKAILQSHIDSKCGQIHQGKIPACVHRSWDCRISGVLAVAPFPCIPESQFLVLQTASDPDLHHKVMPWMPTALDQQQQALPGTVTEHPKLLRVLSVEAIEKLETTLRHKHLAFLSGLPALYYVALPRALAPAVTSQSVITEMEPSPVEIPAEPLI

SEQ ID NO: 28937 - protein, 450 aa, Homo sapiens
MEDFHQKSDIIWLIFKYNYFTCYIKNGLKLSQQEKTGRPITGGFLHQYRSWPCHRQPARLVREAFPAGRAHPAAPAPVPARGIVGRFPLLFNRQRHLGPSFPVRWDGAPMRLCLIPRNTGTPQRVLRPVVWSPPSRKKPVLSPHNSIMFGHLSPVRIPCLRGKFNLQLPSLDDQVIPARLPKTEVSAEEPKEATEVKDQVETQGQEDNKRGPCSNGEAASTSRPLETQGNLTSSWYNPRPLEGNVHLKSLTEKNQTDKAQVHAVSFYSKGHGVASSHSPAGGILPFGKPDPLPTVLPAPVPGCSLWPEKAALKVLGEDHLPSSPGLLMVGEDMQPKDPAALGSSRSSPPRAAGHRSHKRKLSGPPLQLQPTPPLQLRCDRDERPPPAKLPCLSPEALLVGQASQREGRLQHGNMRKNMRVLSRISKFRRLRQLLRRRKKTRQGRRGGSCL

SEQ ID NO: 28938 - protein, 450 aa, Homo sapiens; identical to SEQ ID NO: 28937

SEQ ID NO: 28939 - protein, 211 aa, Homo sapiens
MHTSSSPRFVCRTSCPCCPSSFSWHLPQSSLWEPCSSSQRPCTHHQHPFHLQLKIREVPRRSCSHQSHGAACEAEAPPTGPPPNWHHCCPCPYSQLHVTLGQKQWWGSQGSVKSLSQLQDKFEHLKMIQQEEIRKLEEEKKQLEGEIIDFYKMKAASEALQTQLSTDTKKDKHPDPYEFLLLRKIKHPGFNEELTITLLIIQKHVAGLSHF

SEQ ID NO: 28940 - protein, 211 aa, Homo sapiens; identical to SEQ ID NO: 28939

SEQ ID NO: 28941 - protein, 211 aa, Homo sapiens
MHTSSSPRFVCRTSCPCCPSSFSWHLPQSSLWEPCSSSQRPCTHHQHPFHLQLKIREVPRRSCSHQSHGAACEAEAPPTGPPPNWHHCCPCPYSQPHVTLGQKQWWGSQGSVKSLSQLQDKFEHLKMIQQEEIRKLEEEKKQLEGEIIDFYKMKAASEALQTQLSTDTKKDKHPDPYEFLLLRKIKHPGFNEELTITLLIIQKHVAGLSHF

SEQ ID NO: 28942 - protein, 211 aa, Homo sapiens; identical to SEQ ID NO: 28941

SEQ ID NO: 28943 - protein, 211 aa, Homo sapiens; identical to SEQ ID NO: 28941

SEQ ID NO: 28944 - protein, 148 aa, Homo sapiens [sequence omitted]

SEQ ID NO: 28945 - protein, 148 aa, Homo sapiens [sequence omitted]

SEQ ID NO: 28946 - protein, 148 aa, Homo sapiens [sequence omitted]

SEQ ID NO: 28947 - protein, 148 aa, Homo sapiens [sequence omitted]

SEQ ID NO: 28948 - protein, 148 aa, Homo sapiens [sequence omitted]

SEQ ID NO: 28949 - protein, 148 aa, Homo sapiens [sequence omitted]

SEQ ID NO: 28950 - protein, 317 aa, Homo sapiens
MTTTQKHDLFTPEPHYVPGYAGFFPQLRYQVGNTYGRTTGQLLTDPSVQKSPCSVLSPMSKPKFIEDFSQSKPPRVPCQDLTEPYIPHYTSLKPSKNFEILGQLPPLEVDAQEPPGVENIPRQILLPAGFTPDTPHPPCPPGRKGDSRDLGHPVYGEEAWKSATPVCEAPRQHQLYHCQRDEYPPPARRQQETLDVGSFQRLPQLDHPNLIQRKAISGYAGFIPRFTWVMGLNYRDGVMQAMDEFDKSQFLFRNPHCDLGEKLPGTHWPSNHIYSSQGLIPFYMGFIPAMQDNYALTFGNSTRRAYWKEWAKRNHTL

SEQ ID NO: 28951 - protein, 258 aa, Homo sapiens
MYIYRKHSFLTLHQIIQYGEKPYECKQCGRPLVVIQTLEYIKNVGRPVIARNVGSHHTDLRIHKRIHTGEKPYQCEDCGTTFSRLTDLRECGKAFSQASNLAQHDRIHTGEKPYKCKECGNAFSHTSHLVRRERIHTGEKPRECKECGKAFRSNHQLTIHHRFHTGEKPYECKECGKAFSVYGRLSQHESIHSGERPFQCNKCGKSFRLSSSLKVHQSMHTGEKPFECDKCGKSFRFSSILQVYHRIHTSEILYGIYI

SEQ ID NO: 28952 - protein, 541 aa, Homo sapiens
MAIWKRGNLSRESSQCQGSEQPEWLDWSVAMRRIGVYMLMGMIHSKGENDETGKRETLLVRGAHVEERLVKNTAIDHGKHESVGGLRFFLALCGLNARDAMMEDVGQNPLDDVLERKLALSLEEAKEEEELNYVIDEQEESLRELELETAKLEKSNAILSRNVVEVQKKISGLFTNIGLEEETTKQILEEMKARLQKSTESCAKQEEELAKAEAMSLPLRLFTQFGNLNVLFCDMSFACICEMERTTIKKQERRCWYKYFQYLTFMVLVFIRLLAYVIFHLQYINPDLLVDVLPLVLSRGTLENLEVGLYEVDKQGPLLSVEFIHGGAQTPGMQPGGFCDSANDPWTKRHTKPVLPASDKDRHFDAIKYFSGNLGVLLRLRFQEVSSVKTGSLYDNFQHLRSRTARLRGQGGQATGAKRPLRIWRRGNLGNSGEFQTSSLPPSEQVQSVRLERRSETGKLGTRSERLVVALALVRPARARKAGPVACGAEPRWRSAQLPLWALALDWSAASFEAAAATAVAVSELMQMGYGSLQVPYSTTS

SEQ ID NO: 28953 - protein, 68 aa, Homo sapiens
MHTLRALTRIHTPSLPRSPPRPPSRSRALRSGNRGRSGDRRQPSRGMPARSGAARGRRARDASGTHRP

SEQ ID NO: 28954 - protein, 274 aa, Homo sapiens
MEQLQDETNHLRKELESVGRQLQAEVENNQMLSLLNRRQEERLREQEERLREQEERLCEQEERLCEQEERLREQEERLCEQEKLPGQERLLEEVEKLLEQERRQEEQERLLERERLLDEVEELLEQERLRQQDERLWQQETLRELERLRELERMLELGWEALYEQRAEPRSGFEELNNENKSTLQLEQQVKELEKSGGAEEPRGSESAAAARPVAGAPVPQGAWMCGQAGWTPQEHPGLSGEAVGTGEAAGGAGEAACHSFRAAENRELNITII

SEQ ID NO: 28955 - protein, 83 aa, Homo sapiens
MASTPMGNEGEKKSSWPSQAAPSLRGGPASLSRSEEYLSQISAELMEEALCTACCHLNPVPIKKKQSQDQATQISKRAFFTKT

SEQ ID NO: 28956 - protein, 83 aa, Homo sapiens; identical to SEQ ID NO: 28955

SEQ ID NO: 28957 - protein, 227 aa, Homo sapiens
MKSILQDLESQESMVAFLTSAVASADGEQARLRGQLKEQRLRCRCLAHLLAWAQKQPEAAAPAPGTGMDSVCGGTHRALQGAMEKLQSCFMQLMQEKVDLKERVEELEHRCIQLSGETDTIGVYTALSQPGGSAEGAAPRGGGAHPQASPGQGGDEDLCQVTLTSSVEPAQGEAGEGSPLDNPSAQQIMQLFGEMQNPQERPGLGSIPCILFSHQADKNHQVKITLI

SEQ ID NO: 28958 - protein, 227 aa, Homo sapiens; identical to SEQ ID NO: 28957

SEQ ID NO: 28959 - protein, 211 aa, Homo sapiens; identical to SEQ ID NO: 28941

SEQ ID NO: 28960 - protein, 211 aa, Homo sapiens; identical to SEQ ID NO: 28941

SEQ ID NO: 28961 - protein, 211 aa, Homo sapiens; identical to SEQ ID NO: 28941

SEQ ID NO: 28962 - protein, 119 aa, Homo sapiens
MHIASCKKSDCCAVFYPLWPRSRDNAGIRAPTGFCEPLSAPRPDSEARSRLQFEAPCAAPWWPEAVTVAAEGASRCIRSAPWPPSGGRRPLLSRLRGRPGVSAARPGRPLVAGGRYCRG

SEQ ID NO: 28963 - protein, 131 aa, Homo sapiens
MREFSLIELWLMPKVFNHYVWGSFLVQRKKKQPKSVLVYHCTSGNLNPCNRGKMGFQVLATFEIPIPFERALTRPYADFTTSNFRTQYWNAISQQAPAIIYDFYLWLTGRKPSYRRKIPSSTQFYKWRNRS

SEQ ID NO: 28964 - protein, 379 aa, Homo sapiens
  VARIANT 287, 291, 294, 341, 344, 347: Xaa = Any Amino Acid
MGNRAHRPGRAAASATPSRLRSRTRAVHLPHRAQLLPELRARPRCAGGECPSLSALRISPFPGPLGSRKSFSSHVYIPFILPPGNSSPFTAATDARVHARSCTFKETLKSWRPENQLSGGAVGLPLPLLRLCRSLCSREGWPHILTRTRVVHNAEVNFAQSRQKRPPPPTNIPSCSVSLSGPARRARGDRSPRDRKPRLLSGRVGRECESRRARGQQGEGAEARAHRARGPLFSRHAGLEVQAPVPRRGPAMCRSSARRPPQPVPSGRRRRRCPPSSPRPHPRADTXASRXPRXQRPRRVPGCWPPTGRWAPRARARATRWPVPRQGAPRLRGFPRRRSGXRRXGRXRAAPPWRGRRRPRTRSQRFSAEDSKMPQGMFV

SEQ ID NO: 28965 - protein, 379 aa, Homo sapiens; identical to SEQ ID NO: 28964
  VARIANT 287, 291, 294, 341, 344, 347: Xaa = Any Amino Acid

SEQ ID NO: 28966 - protein, 146 aa, Homo sapiens
MDTQNVSKALAVGTYLTGNEPCLNLEKTAIKIQSWWRGNMVRRTLLQAALRAWVIQCWWRSMQAKMLEQRRRLALRLYTCQEWAVVKVQAQVRMWQARRRFLQARQAACIIQSHWRWHASQTRGLIRGHYEVRASRLELDIEILMT

SEQ ID NO: 28967 - protein, 149 aa, Homo sapiens
MVDDAGAAESQRGKQTPAHSLEQLRRLPLPPPQIRIRPWWFPVQELRDPLVFYLEAWLADELFGPDRAIIPEMEWTSQALLTVDIVDSGNLVEITVFGRPRVQNRVKSMLLCLAWFHREHRARAEKMKHLEKNLKAHASDPHSPQDPVA

SEQ ID NO: 28968 - protein, 139 aa, Homo sapiens
MAAGSSGASMGWRGSPGRPSGRSQHRPRTSSACARWARYGGSFQGFYPNSTYFYLFSLELFCLYLSFICKNSIRKIHRVNAHQAYRRSGRNMFSPAHFQSVFEHRGFHGFDSFHKRLVLSVFTIYVSETINYIIFMFTH

SEQ ID NO: 28969 - protein, 135 aa, Homo sapiens [sequence omitted]

SEQ ID NO: 28970 - protein, 135 aa, Homo sapiens [sequence omitted]

SEQ ID NO: 28971 - protein, 69 aa, Homo sapiens [sequence omitted]

SEQ ID NO: 28972 - protein, 134 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGRFKDWMVSMIMDREYSVAVEAVRLLILILKNMEGVLMDVDCESVYPIV

SEQ ID NO: 28973 - protein, 80 aa, Homo sapiens
MQHREVRVKCVKALKGLYGNRDLTARLELFTGRFKDWMVSMIVDREYSVAVEAVRLLILILKNMEGVLMDVDCESVYPIV

SEQ ID NO: 28974 - protein, 183 aa, Homo sapiens
MHTSSSPSSSQRPCTHHQHPFHLQLKIREVPRRSCSHQSHGAAREAEAPPTGPPPNWHHCCPCPYSQPHVTLGQRQWWGSQGSVKSLSQLQDKFEHLKMIQQEEIRKLEEEKKQLEGEIIDFYKMKAASEALQTQLSTDTKKDKHPDPYEFLLLRKIKHPGFNEELTITLLIIQKHVARLSHF

SEQ ID NO: 28975 - protein, 666 aa, Homo sapiens
MSEKTQQGKLAAAKKKLDLPRLLGLASLRTWVETVCFPPPSWSSDSGIALMWSPPLGGVECNDVTVPLGTVITAARPAFDLTTQSPKFSHPISGSSGCSTNFQLEGEWRLWDLGARGFRLPYSLNIDIDSGKSLHFPCELKMFTLKAYWQRKSPGIPAGANRKKKVNGSSPDTATSGGYHSPGDSATGVYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEERLREQEERLCEQEERLREQEERLCEQEERLREQEERLCEQEERLREQEERLCEQEERLREQEERLCEQEERLREQEERLCEQEERLREQEERLCEQEERLCEQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 28976 - protein, 528 aa, Homo sapiens
MSEKTQQGKLAAAKKKLDLPRLLGLASLRTWVETVCFPPPSWSSDSGIALMWSPPLGGVECNDVTAPLGTVITAARPAFDLTTQSPKFSHPISGSSGCSTNFQLEGEWRLWDLGATGFRLPYSLNIDIDSGKSLHFPCELKMFTLKAYWQRKSPGIPAGANRKKKVNGSSPDTATSGGYHSPGDSQYQELAVALDSSSAIISQLTENINSLVRTSKEEKKHEIHLVQKLGRSLFKLKNQTAEPLAPQPPAGPSKVEQLQDETNHLRKELESVGRQLQAEVENNQMLSLLNRRQEERLREQEERLREQEERLCEQEERLCEQEERLREQEERLCEQEKLPGQERLLEEVEKLLKQERRQEEQERLLERERLLDEVEELLEQERLRQQDERLWQQETLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAGEAACHSFRAAENRELNITII

SEQ ID NO: 28977 - protein, 244 aa, Homo sapiens
MLSLLNRRQEERLREQEERLREQEERLREQEERLCEQEERLREQEERLCEQEKLPGQERLLEEVEKLLEQERRQEEQERLLERERLLEEVEELLEQERLRQQDERLWQQETLQELERLRELERMLELGWEALYEQRAEPRSGFEELNNENKSTLQLEQQVKELKKSGGAEEPRGSESAAAARPVAGAPVPQGAWMCGQAGWTPQEHPGLGGEAVGTGEAAGGAGEAACHSFRAAENRELNITII

SEQ ID NO: 28978 - protein, 503 aa, Homo sapiens
MWPQPRLPPHPAMSEKTQQGKLAAAKKKLKAYWQRKSPGIPAGANRKKKINGSSPDTATSGGYHSPGDSQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLREQEERLREQEERLCEQEERLREQEERLREQEERLCEQEERLREHEERLCEQEERLCEQEERLREQEERLHEQEERLCEQEERLREQEERLCEQEERLREQEERLCEQEERLREQEERLCEQEKLPGQERLLEEVEKLLEQERRQEEQERLLERERLLEEVEELLEQERLRQQDERLWQQETLQELERLRELERMLELGWEALYEQRAEPRSGFEELNNENKSTLQLEQQVKELKKSGGAEEPRGSESAAAARPVAGAPVPQGAWMCGQAGWTPQEHPGLGGEAVGTGEAAGGAGEAACHSFRAAENRELNITII

SEQ ID NO: 28979 - protein, 244 aa, Homo sapiens; identical to SEQ ID NO: 28977

SEQ ID NO: 28980 - protein, 335 aa, Homo sapiens
MLSLLNRRQEERLREQEERLREQEERLREQEERLCEQEERLREQEERLREQEERLCEQEERLREHEERLCEQEERLCEQEERLREQEERLHEQEERLCEQEERLREQEERLCEQEERLREQEERLCEQEERLREQEERLCEQEKLPGQERLLEEVEKLLEQERRQEEQERLLERERLLEEVEELLEQERLRQQDERLWQQETLQELERLRELERMLELGWEALYEQRAEPRSGFEELNNENKSTLQLEQQVKELKKSGGAEEPRGSESAAAARPVAGAPVPQGAWMCGQAGWTPQEHPGLGGEAVGTGEAAGGAGEAACHSFRAAENRELNITII

SEQ ID NO: 28981 - protein, 335 aa, Homo sapiens; identical to SEQ ID NO: 28980

SEQ ID NO: 28982 - protein, 408 aa, Homo sapiens
MQATPSEAEAGGESPQSCVSAAHSDWTAGKPVSLLAPLIPPRSAGQPLTFSPSGRQPLRSLLVGMCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEYKSDSGKPYYYNSQTKESRWAKPKELEDLEGYQNTIVAGSLITKSNLHAMIKAEESSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVAE

SEQ ID NO: 28983 - protein, 287 aa, Homo sapiens
MQATPSEAEAGGESPQSCVSAAHSDWTAGKPVSLLAPLIPPRSAGQPLTFSPSGRQPLRSLLVGMCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEYKSDSGKPYYYNSQTKESRWAKPKELEDLEGYQNTIVAGSLITKSNLHDDFFSLFNSNDQS

SEQ ID NO: 28984 - protein, 89 aa, Homo sapiens
MWRHLAKRTLIRVFDGAATNERFEETPKVPPVYNNLELPFSQQLLFQDAASFQSHVLLMSWSCPENSQCSFPTLSCHCSFLFPILSVRK

SEQ ID NO: 28985 - protein, 127 aa, Homo sapiens
MGNLCGCIQGDSKKPSKKRVKRKPYSTTKVTSGSTFNENIRRYAVHTNQCRRPHGSRVKKKRYPQEDDFHHTVFSNLERLDKLQPTLEASEESLVHKDRGDGERPVNARVVQVAPLRLESRAIDTGE

SEQ ID NO: 28986 - protein, 68 aa, Homo sapiens; identical to SEQ ID NO: 28740

SEQ ID NO: 28987 - protein, 127 aa, Homo sapiens [sequence omitted]

SEQ ID NO: 28988 - protein, 68 aa, Homo sapiens; identical to SEQ ID NO: 28740

SEQ ID NO: 28989 - protein, 75 aa, Homo sapiens
MRLMIDSNLLSYTGALDFPINRGRPRVIANPGVVKRNCSSEEKLHLYKKGRRRPEQYIRRIQQSILRHERASGQN

SEQ ID NO: 28990 - protein, 102 aa, Homo sapiens [sequence omitted]

SEQ ID NO: 28991 - protein, 102 aa, Homo sapiens [sequence omitted]

SEQ ID NO: 28992 - protein, 147 aa, Homo sapiens
MAPGPWPVSCLRGGPLGLTYLSLLLIPAAAGTYCECSLGLSREALIALLVVLAGISASCFCALVIVAIGVLRAKGETCPRQVDNRLVENFGVQEDLMDLHPVYVESQLMDADLEVSLVPPLEDQSLVAIPMEASSEEPPPPPPLPPE

SEQ ID NO: 28993 - protein, 250 aa, Homo sapiens
MLSLLNRRQEERLREQEERLHEQEERLREQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 28994 - protein, 250 aa, Homo sapiens; identical to SEQ ID NO: 28993

SEQ ID NO: 28995 - protein, 348 aa, Homo sapiens
MLSLLNRRQEERLREQEERLHEQEERLHEQEERLCEQEERLREQEERLCEQEERLREQEERLREQEERLREQEERLHEQEERLHEQEERLCEQEERLREQEERLCEQEERLREQEERLCEQEERLREQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 28996 - protein, 294 aa, Homo sapiens
MSDYYMVIRVANKTEKETTAAPPTNTETARWEGVPGETPISLPTEVEPWEVHKVCSREKPEPGPSFSFVEPGIQTVRWEALRRKDSGPARALSRPPCPELRSPFRSRGLQASSFRHTLQRSVPAAAPGGGRREARLRPALAPPPTRPREICLGLDPPPTVSPQPPALLALVTRAGSPERNQKDRKGIPGLPFHIRQERDPPPARSACPGAPRCLQLQEDVWEQTQKLSLPDKQDKETQTKSWPVWSRSGLRDDKKICSVQMAHLVPTKPWGPRKIRHPLLTSPSSRAPSSRAHL

SEQ ID NO: 28997 - protein, 229 aa, Homo sapiens
MPSRKQTGVFGVKIAVVTKRERSKVPYIMRQCVEEIERRGMEEVGIYRVSGVATDIQALKAGFNVNNKDVSVMMSEMDVNAIAGTLKLYFRELPEPLFTDEFYPNFAEGIALSDPVARKSCMLNLLLSLPEANLLTFLFLLDHLERVAEKEAVNKVSLHNLATVFGPTLLRPSEKESKLPANPSQPVTMTDSRSLEVMSQDEVLLYFLRLEAIPALNSKRQSILFSTDV

SEQ ID NO: 28998 - protein, 88 aa, Homo sapiens
MDDADPEERNYDNMLKMLSDLNKDLEKLLEEMEKISVQATWMAYDMVVMRTNPTLAESMRRLEDAFVNCKEEMEKNWQELLHETKQRL

SEQ ID NO: 28999 - protein, 210 aa, Homo sapiens
MHTSSPRFVCRTSCPCCPSSFSWHLPQSSLWEPRSSSQRPCTHHQHPFHLQLKIREVPRRSCSHQSHGAAREAEAPPTGPPPDWHHCCPCPYSQPHVTLGQRQWWGSQGSVKSLSQLQDKFEHLKMIQQEEIRKLEEEKKQLEGEIIDFYKMKAASEALQTQLSTDTKKDKHPDPYEFLLLRKIKHPGFSEELTITLLIIQKHVADLSHF

SEQ ID NO: 29000 - protein, 724 aa, Homo sapiens
MGNKYLQRTGVNLKDAYKGSNARTPLILIQTHGIDLTNILLRFAQELKGTTHHVTIISLGRDQAAKAEDLILKALTKTQQWVFLQNCHLATSFMPRLCTIVESFNSPNVTIDPEFRLWLSSKSYSSFPIPVLKKGLKIAVESPQGLKSNLLQTFGCTGSGEVTEEIFENPDCGQWWKKLLFSLCFFNAVINERKNYGILGWNIAYKFNSSDLGVAIKVLENSLRGQPSISWQALRYLIGEVIYGGRVIDNWDKRCLKTLLYKFCNPEVLKDDFSFSSDGICLPVPGSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 29001 - protein, 52 aa, Homo sapiens
MISAMFSNRVRKQTALREKAGTQNQINSKLKFSHFDKKRNCMCFSASCRCMS

SEQ ID NO: 29002 - protein, 211 aa, Homo sapiens
MHTSSSPRFVCRTSCPCCPSSFSWHLPQSSLWEPCSSSQRPCTHHQHPFHLQLKIREVPRRSCSHQSHGAACEAEAPPTGPPPNWHHCCPCPYSQPHVTLGQKHWWGSQGSVKSLSQLQDKFEHLKMIQQEEIRKLEEEKKKLEGEIIDFYKMKAASEALQTQLSTDTKKDKHPDPYEFLLLRKIKHPGFNEELTITLLIIQKHVAGLSHF

SEQ ID NO: 29003 - protein, 68 aa, Homo sapiens
MCLYCWDIEPSQVNPEGPRQHHPSEVTERQLANKRIQNMQHLKKEKRRLNKRFSRPSPIPEPGLLWSS

SEQ ID NO: 29004 - protein, 242 aa, Homo sapiens
MWASRDHLPEPDLGDAAPPGSPSSFWTSGLPRQERSTSRQRSRGSPSSTCVPYKVHALATFECSATSHASRLWQTLQQFWADHISRPFSPRRPPLRRMPSLSTFYLLDHNTRQAELGLAYGAPCMRLSNQAFVFRGGRWTTESQLARTRSPLLSRTAWGWKAQVQRSKSQVLLEENNYLKLQQELLIDMLTETMARMHLLEKQRNPEVIPTAAARAGQRKMRKRAGASAGVLMIQPCALDSQ

SEQ ID NO: 29005 - protein, 77 aa, Homo sapiens
MGEGGLCESAEARSGGRREPLPGPLSVASEMRRWVRVSPTEARIQVEGSPERWLENVEGAGGHPSILKAIPMAKINS

SEQ ID NO: 29006 - protein, 206 aa, Homo sapiens
MPTSSCLSQNPKASSQPFHGCTDTYPWDRLYLSSLRCQIFPLQTGWKREPAQRHFFSKHDNRTSFDKEGPYCLLQGIGRRKDLERLWQRHTFLRWAPCEIELRQQGPLESSYQADFRPGPGLSGLPQHLIHFVQVQPSHTRTTYQQNFCCPSQGGHYGSYKVGPQAPVTDVLPDLPGIPRPKLLQHYLHAGVSECLNWSRALNKDS

SEQ ID NO: 29007 - protein, 81 aa, Homo sapiens
MKNISLRLMALGCSQKHLRGRTLLQMVMLPFERYDAFPDCGRLSMGETEKSSNILTNCFPRFFSQLLDHIRKRKVSLGFRT

SEQ ID NO: 29008 - protein, 65 aa, Homo sapiens
MSKIEDMKRKELTEEVKKGDQEEPSKCYPGIQVKTVFQSGNEQCPVTLRVRLESECRLFSFEISR

SEQ ID NO: 29009 - protein, 595 aa, Homo sapiens
MSEKTQQGKLAAAKKKLDLPRLLGLASLRTWVETVCFPPPSWSSDSGIALMWSPPLGGVECNDVTVPLGTVITAARPAFDLTTQSPKFSHPISGSSGCSTNFQLEGEWRLWDLGARGFRLPYSLNIDIDSGKSLHFPCELKMFTLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEERLCEQEERLREQEERLREQEERLHEQEERLCEQEERLCEQEERLCEQEKLPGQERLLEEVEKLLEQERRQEEQERLLERERLLDEVEELLEQERLRQQDERLWQQETLRELERLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 29010 - protein, 121 aa, Homo sapiens
MLELGWEALYEQRAEPRSGFEELNNENKSTLQLEQQVKELEKSGGAEEPRGSESAAAARPVAGAPVPQGAWMCGQAGWTPQEHPGLGGEAVGTGEAAGGAGEAACHSFRAAENRELNITII

SEQ ID NO: 29011 - protein, 242 aa, Homo sapiens; identical to SEQ ID NO: 29004

SEQ ID NO: 29012 - protein, 408 aa, Homo sapiens; identical to SEQ ID NO: 28982

SEQ ID NO: 29013 - protein, 287 aa, Homo sapiens; identical to SEQ ID NO: 28983

SEQ ID NO: 29014 - protein, 84 aa, Homo sapiens
MVIDQQLLEYKQKISKNSQNSNPEGTCEGTPDEAAPLAERTPDMAESLVERTPDEQHTVSSSSEILACKNPLKFKRGKIKYNEF

SEQ ID NO: 29015 - protein, 252 aa, Homo sapiens [sequence omitted]

SEQ ID NO: 29016 - protein, 65 aa, Homo sapiens; identical to SEQ ID NO: 29008

SEQ ID NO: 29017 - protein, 149 aa, Homo sapiens [sequence omitted]

SEQ ID NO: 29018 - protein, 89 aa, Homo sapiens; identical to SEQ ID NO: 28984

SEQ ID NO: 29019 - protein, 75 aa, Homo sapiens; identical to SEQ ID NO: 28989

SEQ ID NO: 29020 - protein, 578 aa, Homo sapiens [sequence omitted]

SEQ ID NO: 29021 - protein, 724 aa, Homo sapiens
MGNKYLQRTGVNLKDAYKGSNARTPLILIQTHGIDLTNILLRFAQELKGTTHHVTIISLGRDQAAKAEDLILKALTKTQQWVFLQNCHLATSFMPRLCTIVESFNSPNVTIDPEFRLWLSSKSYSSFPIPVLKKGLKIAVESPQGLKSNLLQTFGCTGSGEVTEEIFENPDCGQWWKKLLFSLCFFNAVINERKNYGILGWNIAYKFNSSDLGVAIKVLENSLRGQPSISWQALRYLIGEVIYGGRVIDNWDKRCLKTLLYKFCNPEVLKDDFSFSSDGICLPVPGSASIKDYIHIIQSLPDDDPPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEICNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 29022 - protein, 88 aa, Homo sapiens; identical to SEQ ID NO: 28998

SEQ ID NO: 29023 - protein, 479 aa, Homo sapiens
MSFQAPRRLLELAGQSLLRDQALAISVLDELPRELFPRLFVEAFTSRRCEVLKVMVQAWPFPCLPLGSLMKTPDLEILHYVVDGIDCLLAQKVRPRRWKLQVLEMRDVDENFWTIWSGARPLSCSPEAMSKRQTVEDCPRTGEKQPLKVFMDVCLKEKSVDEDLSFFSGWVQHRRRSVHLCCTKVVNYSMNILNFRNILETVYPDSIQVLEIWNMCWPCMVAEVSRYLSQMKNLRKLFISDGCGYLPSFESQGQLVAEFSSVFLRLEYLQMLYMRRIRFFEGYLDQLIRCLKSPLETLALTYGSLDEEDLKCLPWYPSLSQLKQLNLSHGTLRFIRLEPLRALLEKVAATLQTLFLVDCGIGDSKLRVILPALSRCSNLTTFCFHGNDTSMDGLKDLLRHTGRLSNLSLETYPAPRESLDNRGRVISELLTPLQAELMRILREVREPNRIFFGPVSCPCCGMSPTEQLEFNFCLRGRPA

SEQ ID NO: 29024 - protein, 332 aa, Homo sapiens
MSDYYMVIRVANKTEKETTAAPPTNTETARWEGVPGETPISLPTEVEPWEVHKVCSREKPEPGPSFSFVEPGIQTVRWEALRRKDSGPARLQVTAPPSLQGGALQKRRGGTEGGVLGLRDSRLHGLLGSLAPTLPRATEPLPVPRTPSLKFPPHPPEKRPRRSPGGGGRREARLRPALAPPPTRPREICLGLDPPPTVSPQPPALLALVTRAGSPERNQKDRKGIPGLPFHIRQERDPPPARSACPGAPRCLQLQEDVWEQTQKLSLPDKQDKETQTKSWPVWSRSGLRDDKKICSVQMAHLVPTKPWGPRKIRHPLLTSPSSRAPSSRAHL

SEQ ID NO: 29025 - protein, 80 aa, Homo sapiens
MENILCFLNSYTETGLSPDSHCLDIDLNFICLSGLGLFILYLFYMVLTLYSSPTEKNNDTQKTGKVCRRKQKRKESYILF

SEQ ID NO: 29026 - protein, 52 aa, Homo sapiens; identical to SEQ ID NO: 29001

SEQ ID NO: 29027 - protein, 394 aa, Homo sapiens [sequence omitted]

SEQ ID NO: 29028 - protein, 77 aa, Homo sapiens; identical to SEQ ID NO: 29005

SEQ ID NO: 29029 - protein, 164 aa, Homo sapiens
MSGSPQASYPQTHSFTLKHQEIRTFWNLNMRGLGGEGGTEEESSLGQAGGKLKTAAWPSWVAEVGAAGALADPGGQKSGSFLPSQDSHKDFRGSWQLLHFQLPDPSHFPLPTNSNLGPSRGKQLQPSLTPLQMETCAPGCEHFKGCHTGHTLRCLDSFDEKAKP

SEQ ID NO: 29030 - protein, 135 aa, Homo sapiens
MRGLGGEGGTEEESSLGQAGGKLKTAAWPSWVAEVGAAGALADPGGQKSGSFLPSQDSHKDFRGSWQLLHFQLPDPSHFPLPTNSNLGPSRGKQLQPSLTPLQMETCAPGCEHFKGCHTGHTLRCLDSFDEKAKP

SEQ ID NO: 29031 - protein, 628 aa, Homo sapiens [sequence omitted]

SEQ ID NO: 29032 - protein, 68 aa, Homo sapiens [sequence omitted]

SEQ ID NO: 29033 - protein, 216 aa, Homo sapiens
MASMGTTEANSRTSSCLSQNPKASSQPFHGCTDTYPWDRLYLSSLRCQIFPLQTGWKREPAQRHFFSKHDNRTSFDKEGPYCLLQGIGRRKDLERLWQRHTFLRWAPCEIELRQQGPLESSYQADFRPGPGLSGLPQHLIHFVQVQPSHTRTTYQQNFCCPSQGGHYGSYKVGPQAPVTDVLPDLPGIPRPKLLQHYLHAGVSECLNWSRALNKDS

SEQ ID NO: 29034 - protein, 127 aa, Homo sapiens [sequence omitted]

SEQ ID NO: 29035 - protein, 147 aa, Homo sapiens; identical to SEQ ID NO: 28992

SEQ ID NO: 29036 - protein, 211 aa, Homo sapiens
MHTSSSPRFVCRTSCPCCPSSFSWHLPQSSLWEPCSSSQRPCTHHQHPFHLQLKIHEVPRRSCSHQSHGAACEAEAPPTGQPPNWHHCCPCPYSQPHVTLGQKHWWGSQGSVKSLSQLQDKFEHLKMIQQEEIRKLEEEKKQLEGEIIDFYKMKAASEALQTQLSTDTKKDKHPDPYEFLLLRKIKHPGFNEELTITLLIIQKHVAGLSHF

SEQ ID NO: 29037 - protein, 211 aa, Homo sapiens; identical to SEQ ID NO: 29036

SEQ ID NO: 29038 - protein, 92 aa, Homo sapiens
MVLQENGYGVEEDIPTLLMAASSMDDILAITGFNTCLSIVFSSGCARSSGSRNSKSLRTPLGTICEGCDDSSIFSHLDHSSKWSSTYGHSGA

SEQ ID NO: 29039 - protein, 65 aa, Homo sapiens [sequence omitted]

SEQ ID NO: 29040 - protein, 127 aa, Homo sapiens
MGNLSCCIQGDSKKPSQRRVKRQPYSTTKVTSGSTFNENTRRYAVHTNQCRRPHGSRVKKKRYPQEDDFHHTVFSNLERLDKLQPTLEASEESLVHKDRGDGERPVNARVVQVAPLRLESRAIDTGE

SEQ ID NO: 29041 - protein, 68 aa, Homo sapiens
MGNLSCCIQGDSKKPSQRRVKRQPYSTTKVTSGSTFNGTYSGITHWLLEKDSIGNLELNCWLLSGEPP

SEQ ID NO: 29042 - protein, 68 aa, Homo sapiens; identical to SEQ ID NO: 29041

SEQ ID NO: 29043 - protein, 430 aa, Homo sapiens
MGNLSCCIQGDSKKPSQRRVKRQPYSTTKVTSGSTFNENTRRYAVHTNQCRRPHGSRVKKKRYPQEDDFHHTVFSNLERLDKLQPTLEASEESLVHKDRGDGERPVNARVVQVAPLRLESTPHEDTVHDITNEDATHDIANEDTVHDIANEAADKGIANEDAAQGIASEDAAQGIAREDAAQGIAKEDAAQGIAKEGAAQGIAKEDAAHGIANEDSAHGIASEDAAHGIASEDAVQGIAKEDAAQGIANEDAAQGIAKEDAAQGIAKEDAAQGIANEGAAQGIAKEDAAQGIANEDAAQGIANEDAAHGIASEDAAHGIASEDAVQGIAKEDAAQGIANEDAAQGIANEDAAQGIAKEDAAHGIANELYTTSLTRTPYKPSLTSTLYTTSLMRALYKTSPMRALYTTLLMAPTRHANVDAVHDIANEDSV

SEQ ID NO: 29044 - protein, 277 aa, Homo sapiens
MRTPYTTSLTRTPHTTSLTRILYTTSLTRPPTRASPTRTPPTASPARTPPTESPARTPPTASPARTPPRASPARTPPRASPGRTPPRASPRRTPPRASPRRAPPRASPRRTPPTASPTRTPPTESPARTPPTASPARTPSRASPRRTPPRASPTRTPPRASPRRTPPRASPRRTPPRASPTRAPPRASPKRTPPRASPTRTPPRASPTRTPPTESPARTPPTASPARTPSRASPRRMPPRASPTRTPPRASPTRTPPRASPKRTPPTASPTSCIRHR

SEQ ID NO: 29045 - protein, 127 aa, Homo sapiens
MGNLSCCIQGDSKKPSKKRVKRKPYSTTKVTSGSTFNENTRRYAVHTNQCRRPHGSRVKKKRYPQEDDFHHTVFSNLERLDKLQPTLEASEESLVHKDRGDGERPVNVRVVQVAPLRHESRAIDTGE

SEQ ID NO: 29046 - protein, 68 aa, Homo sapiens
MGNLSCCIQGDSKKPSKKRVKRKPYSTTKVTSGSTFNGTYSGITHWLLEKDSTGNLELNCWLLSGEPP

SEQ ID NO: 29047 - protein, 68 aa, Homo sapiens; identical to SEQ ID NO: 28740

SEQ ID NO: 29048 - protein, 68 aa, Homo sapiens; identical to SEQ ID NO: 28740

SEQ ID NO: 29049 - protein, 68 aa, Homo sapiens; identical to SEQ ID NO: 28740

SEQ ID NO: 29050 - protein, 127 aa, Homo sapiens
MGNLCGCIQGDSKKPSKKHVKRKPYSTTKVTSGSTFNENTRRYAVHTNQCRRPHGSRVKKKRYPQEDDFHHTVFSNLERLDKLQPTLEASEESLVHKDRGDGERPVNARVVQVAPLRLESRAIDTGE

SEQ ID NO: 29051 - protein, 430 aa, Homo sapiens
MGNLCGCIQGDSKKPSKKHVKRKPYSTTKVTSGSTFNENTRRYAVHTNQCRRPHGSRVKKKRYPQEDDFHHTVFSNLERLDKLQPTLEASEESLVHKDRGDGERPVNARVVQVAPLRLESTPHEDTVHDITNEDATHDIANEDTVHDIANEAADKGIANEDAAHGIANEDAAHGIASEDAAHGIASEDAAHGIASEDAAQGIANEDAAQGIAKEDAVHGIANEDAAQGIANEDAAQGIAKEDAAQGIANEDAAQGIAKEDAAQGIAKEDAAQGIANEGAAQGIAKEDAAHGIANEDAAQGIANEDAAHGIASEDAAHGIASEDAVQGIAKEDAAQGIANEDAAQGIANEDAAQGIAKEDAAHGIANELYTTSLTRTPYKPSLTSTLYTTSLMRALYKTSPMRALYTTLLMAPTRHANVDAVHDIANEDSV

SEQ ID NO: 29052 - protein, 68 aa, Homo sapiens
MGNLCGCIQGDSKKPSKKHVKRKPYSTTKVTSGSTFNGTYSGITHWLLEKDSTGNLELNCWLLSGEPP

SEQ ID NO: 29053 - protein, 68 aa, Homo sapiens; identical to SEQ ID NO: 29052

SEQ ID NO: 29054 - protein, 250 aa, Homo sapiens
MRTPYTTSLTRTPHTTSLTRILYTTSLTRPPTRASPTRTPPTASPTRTPPTASPARTPPTESPARTPPTASPARTPPRASPTRTPPRASPRRTPSTASPTRTPPRASPTRTPPRASPRRTPPRASPTRTPPRASPKRTPPRASPRRTPPRASPTRAPPRASPKRTPPMASPTRTPPRASPTRTPPTESPARTPPTASPARTPSRASPRRMPPRASPTRTPPRASPTRTPPRASPKRTPPTASPTSCIRHR

SEQ ID NO: 29055 - protein, 211 aa, Homo sapiens; identical to SEQ ID NO: 29002

SEQ ID NO: 29056 - protein, 91 aa, Homo sapiens; identical to SEQ ID NO: 4435

SEQ ID NO: 29057 - protein, 211 aa, Homo sapiens; identical to SEQ ID NO: 29002

SEQ ID NO: 29058 - protein, 211 aa, Homo sapiens; identical to SEQ ID NO: 29002

SEQ ID NO: 29059 - protein, 211 aa, Homo sapiens; identical to SEQ ID NO: 29002

SEQ ID NO: 29060 - protein, 211 aa, Homo sapiens; identical to SEQ ID NO: 29002

SEQ ID NO: 29061 - protein, 211 aa, Homo sapiens; identical to SEQ ID NO: 29002

SEQ ID NO: 29062 - protein, 211 aa, Homo sapiens; identical to SEQ ID NO: 29002

SEQ ID NO: 29063 - protein, 211 aa, Homo sapiens; identical to SEQ ID NO: 29002

SEQ ID NO: 29064 - protein, 211 aa, Homo sapiens; identical to SEQ ID NO: 29002

SEQ ID NO: 29065 - protein, 189 aa, Homo sapiens
MTDKTEKVAVDPETVFKRPRECDSPSYQKRQRMALLARKQGAGDSLIAGSAMSKEKKLMTGHAIPPSQLDSQIDDFTGFSKDRMMQKPGSNAPVGGNVTSSFSGDDLECRETASSPKSQQEINADIKRKLVKELRCVGQKYEKIFEMLEGVQGPTAVRKRFFESIIKEAARCMRRDFVKHLKKKLKRMI

SEQ ID NO: 29066 - protein, 479 aa, Homo sapiens
MSLQAPRRLLELAGQSLLGDQALAISILDELPRELFPPLFVEAFTSRRCEVLKVMVQAWPFPCLPLGSLMKTPDLEILHYVVDGIDCLLAQKVRPRRWKLQVLELRDVDENFWTIWSGARPLSCSPEAMSKRQTVEDCPRTGEKQPLKVFMDVCLKEKFMDEDLSFFSGWVQHRRGSVHLCCTKVVNYSMSILNFRNILETVYPDSIQVLEIWNMCWPCMIVEFSRYLSQMRNLRKLFISDGCRYLLSSDSQEQLVAEFSSVLLRLEYLQMLYVRRVCFFRGHLDQLIRCLRSPLETLALTYGFLEKVDLKCLPRYPSLSQLKQLNLSHGALRFIRLEPLRALLEKVAATLQTLFLVDCGIRDSKLRVILPALSCCSNLTTFCFHGNDTSMDGLKDLLRHTGRLSNLSLETYPAPRESLDDRGRVISELLTPLQAELMRILREVREPKRIFFGPVSCPCCGTSPTEQLEFNFCLWGRPA

SEQ ID NO: 29067 - protein, 307 aa, Homo sapiens
MAEGDVGAGISHEDRGQESEDEIVDEKLDTSFRISVFKLPIYTSGSLKNNAVLREKKQHFFPAYPQPIYTTHPKPIIKKDIRLERSMKEFFAPQRAGMKLRTFSDIDKYYTEQKKQEYHKEKVRVVAMAQVARERVRVAVNEHLNQKKYATQKLIEENKETIQNSLRQVWQNRFNYLEKARERKALFLKEKSQKASERLLVQNLNNERTLLTRGLLKIDRLEKNEAVLKEKSLIVKQKLKAEKYRKNLLKEMKKVRSQEIYKRHCEEKFVMDMIAFEKACERLQDAKTKVAIVKTNLDFKVPNGLIK

SEQ ID NO: 29068 - protein, 82 aa, Homo sapiens
MRKETTHSSPAAVLGPLALETARVSAPHLEPYVKDVMTVAFLAILITAPNGALLMGILGPKLLTRHYDPSKIKLQLSTLEHH

SEQ ID NO: 29069 - protein, 81 aa, Homo sapiens
MTRVQHQPKNAVLGPLALETARVSAPHLEPYAKDVMTVVFLAILITAPNGALLMGILGPKMLTRHYDPSKIKLQLSTLEHH

SEQ ID NO: 29070 - protein, 307 aa, Homo sapiens; identical to SEQ ID NO: 29067

SEQ ID NO: 29071 - protein, 351 aa, Homo sapiens
MFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRMGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEK

SEQ ID NO: 29072 - protein, 881 aa, Homo sapiens
MEAAAAVVAAEAEVENEDGDSSCGDVCFMDKGLQSISELSLDSTLHAVNLHCNNISKIEAIDHIWNLQHLDLSSNQISRIEGLNTLTKLCTLNLSCNLITKVEGLEELINLTRLNVSYNHIDDLSGLIPLHGIKHKLRYIDLHSNRIDSIHHLLQCMVGLHFLTNLILEKDGDDNPVCRLPGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHMKEKKN

SEQ ID NO: 29073 - protein, 865 aa, Homo sapiens
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKAMEQINSCTALQHLDLSDNNISQIGDLSKLVSLKTLLLHGNIITSLRMAPAYLPRSLAILSLAENEIRDLNEISFLASLTELEQLSIMNNPCVMATPSIPGFDYRPYIVSWCLNLRVLDGYVISQKESLKAEWLYSQGKGRAYRPGQHIQLVQYLATVCPLTSTLGLQTAEDAKLEKILSKQRFHQRQLMNQSQNEELSPLVPVETRASLIPEHSSPVQDCQISQESEPVIQVNSWVGINSNDDQLFAVKNNFPASVHTTRYSRNDLHLEDIQTDEDKLNCSLLSSESTFMPVASGLSPLSPTVELRLQGINLGLEDDGVADESVKGLESQVLDKEEEQPLWAANENSVQMMRSEINTEVNEKAGLLPCPEPTIISAILKDDNHSLTFFPESTEQKQSDIKKPENTQPENKETISQATSEKLPMILTQRSVALGQDKVALQKLNDAATKLQACWRGFYARNYNPQAKDVRYEIRLRRMQEHIVCLTDEIRRLRKERDEERIKKFVQEEAFRFLWNQVRSLQVWQQTVDQRLSSWHTDVPPISSTLVPSKHPLFTQSQESSCDQNADWFIASDVAPQEKSLPEFPDSGFHSSLTEQVHSLQHSLDFEKSSTEGSESSIMGNSIDTVRYGKESDLGDVSEEHGEWNKESSNNEQDNSLLEQYLTSVQQLEDADERTNFDTETRDSKLHIACFPVQLDTLSDGASVDESHGISPPLQGEISQTQENSKLNAEVQGQQPECDSTFQLLHVGVTV

SEQ ID NO: 29074 - protein, 620 aa, Homo sapiens
MQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 29075 - protein, 606 aa, Homo sapiens
MLHTAISCWQPFLGLAVVLIFMGSTIGCPARCECSAQNKSVSCHRRRLIAIPEGIPIETKILDLSKNRLKSVNPEEFISYPLLEEIDLSDNIIANVEPGAFNNLFNLRSLRLKGNRLKLVPLGVFTGLSNLTKLDISENKIVILLDYMFQDLHNLKSLEVGDNDLVYISHRAFSGLLSLEQLTLEKCNLTAVPTEALSHLRSLISLHLKHLNINNMPVYAFKRLFHLKHLEIDYWPLLDMMPANSLYGLNLTSLSVTNTNLSTVPFLAFKHLVYLTHLNLSYNPISTIEAGMFSDLIRLQELHIVGAQLRTIEPHSFQGLRFLRVLNVSQNLLETLEENVFSSPRALEVLSINNNPLACDCRLLWILQRQPTLQFGGQQPMCAGPDTIRERSFKDFHSTALSFYFTCKKPKIREKKLQHLLVDEGQTVQLECSADGDPQPVISWVTPRRRFITTKSNGRATVLGDGTLEIRFAQDQDSGMYVCIASNAAGNDTFTASLTVKGFASDRFLYANRTPMYMTDSNDTISNGTNANTFSLDLKTILVSTAMGCFTFLGVVLFCFLLLFVWSRGKGKHKNSIDLEYVPRKNNGAVVEGEVAGPRRFNMKMI

SEQ ID NO: 29076 - protein, 1156 aa, Homo sapiens
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERYEDLLCCPGWALTPGLLDSIYPSASVPIG

SEQ ID NO: 29077 - protein, 246 aa, Homo sapiens
MGPQHLRLVQLFCLLGAIPTLPRAGALLCYEATASRFRAVAFHNWKWLLMRNMVCKLQEGCEETLVFIETGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 29078 - protein, 194 aa, Homo sapiens
MQDAPLSCLSPTKWSSVSSADSTEKSASGAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALITDDLTDAIICARKIVKETQGMNYWQGWKKHCEGRDLSEWKKGCEVS

SEQ ID NO: 29079 - protein, 148 aa, Homo sapiens
MTKALLIYLVSSFLALNQASLISRCDLAQVLQLEDLDGFEGYSLSDWLCLAFVESKFNISKINENADGSFDYGLFQINSHYWCNDYKSYSENLCHVDCQDLLNPNLLAGIHCAKRIVSGARGMNNWVEWRLHCSGRPLFYWLTGCRLR

SEQ ID NO: 29080 - protein, 434 aa, Homo sapiens
MPNRKASRNAYYFFVQEKIPELRRRGLPVARVADAIPYCSSDWALLREEEKEKYAEMAREWRAAQGKDPGPSEKQKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 29081 - protein, 347 aa, Homo sapiens
MPRGQKSKLRAREKRRKAREETQGLKVAHATAAEKEECPSSSPVLGDTPTSSPAAGIPQKPQGAPPTTTAAAAVSCTESDEGAKCQGEENASFSQATTSTESSVKDPVAWEAGMLMHFILRKYKMREPIMKADMLKVVDEKYKDHFTEILNGASRRLELVFGLDLKEDNPSGHTYTLVSKLNLTNDGNLSNDWDFPRNGLLMPLLGVIFLKGNSATEEEIWKFMNVLGAYDGEEHLIYGEPRKFITQDLVQEKYLKYEQVPNSDPPRYQFLWGPRAYAETTKMKVLEFLAKMNGATPRDFPSHYEEALRDEEERAQVRSSVRARRRTTATTFRARSRAPFSRSSHPM

SEQ ID NO: 29082 - protein, 347 aa, Homo sapiens; identical to SEQ ID NO: 29081

SEQ ID NO: 29083 - protein, 347 aa, Homo sapiens; identical to SEQ ID NO: 29081

SEQ ID NO: 29084 - protein, 373 aa, Homo sapiens
MPPVPGVPFRNVDNDSPTSVELEDWVDAQHPTDEEEEEASSASSTLYLVFSPSSFSTSSSLILGGPEEEEVPSGVIPNLTESIPSSPPQGPPQGPSQSPLSSCCSSFSWSSFSEESSSQKGEDTGTCQGLPDSESSFTYTLDEKVAELVEFLLLKYEAEEPVTEAEMLMIVIKYKDYFPVILKRAREFMELLFGLALIEVGPDHFCVFANTVGLTDEGSDDEGMPENSLLIIILSVIFIKGNCASEEVIWEVLNAVGVYAGREHFVYGEPRELLTKVWVQGHYLEYREVPHSSPPYYEFLWGPRAHSESIKKKVLEFLAKLNNTVPSSFPSWYKDALKDVEERVQATIDTADDATVMASESLSVMSSNVSFSE

SEQ ID NO: 29085 - protein, 623 aa, Homo sapiens
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAGNLGSYATYNQSGYIPSFLKKEVQSAGQRIHLAPLNATASEYTWNTKTGRGQFSGRTYNPTAKNLNIVNRAQPIPSVHGRTDWVAKYGGHR

SEQ ID NO: 29086 - protein, 278 aa, Homo sapiens
MPDQALQQMLDRSCWVCFATDEDDRTAEWVRPCRCRGSTKWVHQACLQRWVDEKQRGNSTARVACPQCNAEYLIVFPKLGPVVYVLDLADRLISKACPFAAAGIMVGSIYWTAVTYGAVTVMQVVGHKEGLDVMERADPLFLLIGLPTIPVMLILGKMIRWEDYVLRLWRKYSNKLQILNSIFPGIGCPVPRIPAEANPLADHVSATRILCGALVFPTIATIVGKLMFSSVNSNLQRTILGGIAFVAIKGAFKVYFKQQQYLRQAHRKILNYPEQEEA

SEQ ID NO: 29087 - protein, 704 aa, Homo sapiens
MESKPSRIPRRISVQPSSSLSARMMSGSRGSSLNDTYHSRDSSFRLDSEYQSTSASASASPFQSAWYSESEITQGARSRSQNQQRDHDSKRPKLSCTNCTTSAGRNVGNGLNTLSDSSWRHSQVPRSSSMVLGSFGTDLMRERRDLERRTDSSISNLMDYSHRSGDFTTSSYVQDRVPSYSQGARPKENSMSTLQLNTSSTNHQLPSEHQTILSSRDSRNSLRSNFSSRESESSRSNTQPGFSYSSSRDEAPIISNSERVVSSQRPFQESSDNEGRRTTRRLLSRIASSMSSTFFSRRSSQDSLNTRSLNSENSYVSPRILTASQSRSNVPSASEVPDNRASEASQGFRFLRRRWGLSSLSHNHSSESDSENFNQESEGRNTGPWLSSSLRNRCTPLFSRRRREGRDESSRIPTSDTSSRSHIFRRESNEVVHLEAQNDPLGAAANRPQASAASSSATTGGSTSDSAQGGRNTGISGILPGSLFRFAVPPALGSNLTDNVMITVDIIPSGWNSADGKSDKTKSAPSRDPERLQKIKESLLLEDSEEEEGDLCRICQMAAASSSNLLIEPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRFINLARTLQAHMEDLETSEDDSEEDGDHNRTFDIA

SEQ ID NO: 29088 - protein, 350 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 29089 - protein, 1980 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 29090 - protein, 840 aa, Homo sapiens
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEGSRNKNDKCMFLLYIEANSISNSKGQKTKSSEDGCKHGMLMEFSLKDLYAIQEIQAEENLFKLIVNSLCPVIFGHELVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 29091 - protein, 824 aa, Homo sapiens
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEANSISNSKGQKTKSSEDGCKHGMLMEFSLKDLYAIQEIQAEENLFKLIVNSLCPVIFGHELVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 29092 - protein, 306 aa, Homo sapiens
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 29093 - protein, 95 aa, Homo sapiens
MGCMKSKQTFPFPTIYEGEKQHESEEPFMPEERCLPRMASPVNVKEEVKEPPGTNIVILEYAHRLSQDILCDALQQWACNNIKYHDIPYIESEGP

SEQ ID NO: 29094 - protein, 64 aa, Homo sapiens
MKPHSYRPLMLRRADRDTAADPKERRLGTNRPLCPGHSDLGPSPQTLLWTPRFAALCCSATQEN

SEQ ID NO: 29095 - protein, 64 aa, Homo sapiens; identical to SEQ ID NO: 29094

SEQ ID NO: 29096 - protein, 188 aa, Homo sapiens
MAPPWAGGERRGPGTTCLHSPWMLEAAPPWAGGEGRELGAACLHSLRMLEAGGSEAATARGRGDFGAASCSDLAFRCASSQNPRSLEPVASSPERRRRQPSRAFACTLPGCWRLEAVTQQQREATLERPHIATSPSAARPPRAQEARNLWHPSLKGEDGNPAEALLGWGLHDRAGLIKWRPTRGSNPG

SEQ ID NO: 29097 - protein, 475 aa, Homo sapiens
MWHAISRTSRMSQSGCPSGLLADKNISSSATRVIVKTAGNQKDFMVADDISVRQFKEMLLAHFQCQMDQLVLVFMGCLLKDHDTLSQRGIMDGHTIYLVIKSKQGSRSLAHSFRDLPTNDPCHRDRNTKGNSSRVHQPTGMNQAPVELAHFVGSDAPKVHTQNLEVSHPECKAQMLENPSIQRLLSNMEFMWQFISEHLDTQQLMQQNPEVSRLLLDNSEILLQTLELARNLAMIQEIMQIQQPSQNLEYPLNPQPYLGLETMPGGNNALGQNYADINDQMLNSMQDPFGGNPFTALLAGQVLEQVQSSPPPPPPSQEQQDQLTQHPATRVIYNSSGGFSSNTSANDTLNKVNHTSKANTAMISTKGQSHICATRQPAGIPALPSIELTQQLQEEYKDATVSLSSSRQTLKGDLQLSDEQSSSQITGGMMQLLMNNPYLAAQIMLFTSMPQLSEQWRQQLPTFLQQTQISDLLSA

SEQ ID NO: 29098 - protein, 191 aa, Homo sapiens
MTDPSLGLTVPMAPPLAPLPPRDPNGAGSEWRKPGAVSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRPNCGIRLPRIRRWRSVRQKRTQQIPETRKRKDKGKGREPWRSPTLWPPGLLG

SEQ ID NO: 29099 - protein, 533 aa, Homo sapiens
MNEENIDGTNGCSKVRTGIQNEAALLALMEKTGYNMVQENGQRKFGGPPPGWEGPPPPRGCEVFVGKIPRDMYEDELVPVFERAGKIYEFRLMMEFSGENRGYAFVMYTTKEEAQLAIRILNNYEIRPGKFIGVCVSLDNCRLFIGAIPKEKKKEEILDEMKKVTEGVVDVIVYPSATDKTKNRGFAFVEYESHRAAAMARRKLIPGTFQLWGHTIQVDWADPEKEVDEETMQRVKVLYVRNLMISTTEETIKAEFNKFKPGAVERVKKLRDYAFVHFFNREDAVAAMSVMNGKCIDGASIEVTLAKPVNKENTWRQHLNGQISPNSENLIVFANKEESHPKTLGKLPTLPARLNGQHSPSPPEVERCTYPFYPGTKLTPISMYSLKSNHFNSAVMHLDYYCNKNNWAPPEYYLYSTTSQDGKVLLVYKIVIPAIANGSQSYFMPDKLCTTLEDAKELAAQFTLLHLDYNFHRSSINSLSPVSATLSSGTPSVLPYTSRPYSYPGYPLSPTISLANGSHVGQRLCISNQASFF

SEQ ID NO: 29100 - protein, 265 aa, Homo sapiens
MSEQQMDLKDLMPTKRKYMWKTAEDRRMSDLTCVLEWLERRQGKKKQAPEKQKPKVVTVLKRNKKKEEKKGKGLMTARGGNRRDTETSQQALGKRFRKDAASYRSLYGVEQKGKHLSMVPGSYIKDGPKKSDTDIKDAVDPESTQRPNPFRRQSIVLDPMLQEGTFNSQRATFIRDWSNKMPDMAYERKLKSLMEKSTEPKMETMRMLKPEEVLSCRYLRLSKENIRTLLKLCKDAGMNVDIHPHMVEEDIDAKKVFTGIPSMAL

SEQ ID NO: 29101 - protein, 416 aa, Homo sapiens
MDASRPKSSESQSSLEAPRPGPNPSPNVVNKPLQRDSPGMVADRLPPKTGAVVIDMGTGTCKVGFAGQASPTYTVATILGCQPKKPATSGQSGLQTFIGEAARVLPELTLVQPLRSGIVVDWDAAELIWRHLLEHDLRVATHDHPLLFSDPPFSPATNREKLVEVAFESLRSPAMYVASQSVLSVYAHGRVSGLVVDTGHGVTYTVPVFQGYNLLHATERLDLAGNNLTAFLAEMLLQAGLPLGQQDLDLVENIKHHYCYVASDFQKEQARPEQEYKRTLKLPDGRTVTLGKELFQCPELLFNPPEVPGLSPVGLSTMAKQSLRKLSLEMRADLAQNVLLCGGSSLFTGFEGRFRAELLRALPAETHVVVAAQPTRNFSVWIGGSILASLRAFQSCWVLREQYEEQGPYIVYRKCY

SEQ ID NO: 29102 - protein, 444 aa, Homo sapiens
MENSGKANKKDTHDGPPKEIKLPTSEALLDYQCQIKEDAVEQFMFQIKTLRKKNQKYHERNSRLKEEQIWHIRHLLKELSEEKAEGLPVVTREDVEEAMKEKWKFERDQEKNLRDMRMQISNAEKLFLEKLSEKEYWEEYKNVGSERHAKLITSLQNDINTVKENAEKMSEHYKITLEDTRKKIIKETLLQLDQKKEWATQNAVKLIDKGSYLEIWENDWLKKEVAIHRKEVEELKNAIHELEAENLVLIDQLSNCRLVDLKIPRYPVLHSCPTSNPRHLLLLPLESCLISARRCWRLYLTQAAGLEVPPEEMSLELPETHIEEKSELQPTEVESRDLMSSSDESTILHLSHENSIEDLQYVKIDKEENSGTEFGDTDMKYLLYEDEKDFKDYVNLGPLGVKLMSVESKKMPIHFQEKEIPVKLYKDVRSPESHITYKMMKSFL

SEQ ID NO: 29103 - protein, 395 aa, Homo sapiens
MALPGYPLGNVDDSRSKDSPAGEPQGQVPLTADVLAVSSSVASTDWQDIDQASFKTATPRAISTSGDKDKSAVVPEHGQKTPRKITPLLPSQNPSPLQVSMSLQNPAWDRQVQDARTSQSLVVFPSHLLGKDKMSQMASVPEREPESAPSAPSAELQSTQHMEAQPVESDADHVTAGANGQHGPQAASTTKSAEEKAEHPKAPHPEAEALPSDESPVAMGANVVDSLGDLQTWFFPPPPAGSVSPSPGPHEVALGRRPLDPSLYTASEENSYMRSMTSLLDRGEGSISSLADILVWSETTMGMAIATGFLDSGHSTVADLLHSSGPSLRSVPSLVGSVSSAFSSGLVSGTSSALRTITRVLETVEQRTVEGIRSAMRYLTSHLTPRQAQADPNYD

SEQ ID NO: 29104 - protein, 253 aa, Homo sapiens
MEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSKIKKINMKKMHNGLDKKNKRLNTSFLWSC

SEQ ID NO: 29105 - protein, 289 aa, Homo sapiens
MEQPGPRAPDPSLCHHNLQPTDDPNWDSYATTMRTAFTPKTGAVPALIRQNGIRRLGYTYSLSDPILNQTQYSDEYTWKSHSKEDLIKTETSRGIKSHKSHLNEDIFLWTLPHCQQTGTLKNCLPWKIPASMKEVNKALSNQFISLTKRDFVDRSKAQKIKKSSHLSLEWKKLLPQPPDTEFRRNYQIPAKIPELQDFSFKYGCYSSLPVASQGLVPSVLHSYLRNQEHTKKQTTYQSDYDKTYPDFLMLLNSFTSSQVKEYLQSLSYKDRQIIDRFIRTHCDTNKKKK

SEQ ID NO: 29106 - protein, 412 aa, Homo sapiens
MLPQNKDQVLPQTSVLPGRPTWGFSQLVDSSPHNLQPLSPHQGLPPSQPPFSSTQSRRPSSPPPASPSPGFQFGSCDSNSDFAPHPYSPSLPSSPTFFHQNYLSLPRPRASSPSNHWLYPSPPLTPSFSPSQPQNSSLPHSPCQSPSHPEELHSSTLTSPGPSPPSHRLHSNRQTWRWHQYRDTGSGSPGVVEGCVPSEKDPAQFRDPGALAQALVVQLGHRRIAHDLRLLLLQHLWLGRTGQAPVVEYPICLVCLRPRSPSCPLPRYRTGPRLLAFPQLLPCVQGQESGPLRIGIGFGLRLPQGQARALHLLPEKRPKEAGPQGKATQACGHQLPASQPPAAQARADPVPGTPSQTRSFRSAGLQSPNSPRCFSGPPPRAPKQVTTSLKPRPCPGPKRPVSLELILQKSSV

SEQ ID NO: 29107 - protein, 202 aa, Homo sapiens
MAEGEEEGGDVLISVGHANVLGYTLREFLQLLQHITIGTVLQIKVYRDFINIPEEWQEIYDLIPEAKFPVTSTPKKIELAKDESFTSSDDNENVDLDKRLQYYRYPWSTVHHPARRPISISRDWHGYKKKNHTISVGKDINCDVMIHRDDKKEVRAPSPYWIMVKQDNESSSSSTSSTSDAFWLEDCAQVEEGKAQLVSKVG

SEQ ID NO: 29108 - protein, 215 aa, Homo sapiens
MTSGANSSGSYLPSEIRSSKIDDNYLKELNEDLKLRKQELLEMLKPLEDKNNLLFQKLMSNLEEKQRSLQIMRQIMAGKGCEESSVMELLKEAEEMKQNLERKNKMLRKEMEMLWNKTFEAEELSDQQKAPQTKNKADLQDGKEKQQRKMEWVKYQEQNNILQNDFHGKVIELRIEALKNYQKANDLKLSLYLQQNFEPMQAFLNLPGSQGIRIV

SEQ ID NO: 29109 - protein, 268 aa, Homo sapiens
MFRMLNSSFEDDPFFSESILAHRENMRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 29110 - protein, 495 aa, Homo sapiens
MGSKRRNLSCSERHQKLVDENYCKKLHVQALKNVNSQIRNQMVQNENDNRVQRKQFLRLLQNEQFELDMEEAIQKAEENKRLKELQLKQEEKLAMELAKLKHESLKDEKMRQQVRENSIELRELEKKLKAAYMNKERAAQIAEKDAIKYEQMKRDAEIAKTMMEEHKRIIKEENAAEDKRNKAKAQYYLDLEKQLEEQEKKKQEAYEQLLKEKLMIDEIVRKIYEEDQLEKQQKLEKMNAMRRYIEEFQKEQALWRKKKREEMEEENRKIIEFANMQQQREEDRMAKVQENEEKRLQLQNALTQKLEEMLRQREDLEQVRQELYQEEQAEIYKSKLKEEAEKKLRKQKEMKQDFEEQMALKELVLQAAKEEEENFRKTMLAKFAEDDRIELMNAQKQRMKQLEHRRAVEKLIEERRQQFLADKQRELEEWQLQQRRQGFINAIIEEERLKLLKEHATNLLGYLPKGVFKKEDDIDLLGEEFRKVYQQRSEICEEK

SEQ ID NO: 29111 - protein, 240 aa, Homo sapiens
MPVSKCPKKSESLWKGWDRKAQRNGLRSQVYAVNGDYYVGEWEDNVKHGKGTQVWKKKGAIYEGDWKFGKRDGYGTLSLPDQQTGKCRRVYSGWWKGDKKSGYGIQFFGPKEYYEGDWCGSQRSGWGRMYYSNGDIYEGQWENDKPNGEGMLRLKNGNRYEGCWERGMKNGAGRFFHLDHGQLFEGFWVDNMAKCGTMIDFGRDEAPEPTQFPIPEVKILDPDGVLAEALAMFRKTEEGD

SEQ ID NO: 29112 - protein, 341 aa, Homo sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 29113 - protein, 248 aa, Homo sapiens
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDIALQTRTLLDDENDSLRYSAFVLFGQLAAFAGRKWKKFFTSQVKQTRDSLLIHLQDRNPQVAKACKTTFQACSPYLKLKEEYSFQSEEDQRNTKLYQQLSHYHPEILQFFYANKIL

SEQ ID NO: 29114 - protein, 430 aa, Homo sapiens
MATAVRAVGCLPVLCSGTAGHLLGRQCSLNTLPAASILAWKSVLGNGHLSSLGTRDTHPYASLSRALQTQCCISSPSHLMSQQYRPYSFFTKLTADELWKGALAETGAGAKKGRGKRTKKKKRKDLNRGQIIGEGRYGFLWPGLNVPLMKNGAVQTIAQRSKEEQEKVEADMIQQREEWDRKKKMKVKRERGWSGNSWGGISLGPPDPGPCGETYEDFDTRILEVRNVFTMTAKEGRKKSIRVLVAVGNGKGAAGFSIGKATDRMDAFRKAKNRAVHHLHYIERYEDHTIFHDISLRFKRTHIKMKKQPKGYGLRCHRAIITICRLIGIKDMYAKVSGSINMLSLTQGLFRGLSRQETHQQLADKKGLHVVEIREECGPLPIVVASPRGPLRKDPEPEDEVPDVKLDWEDVKTAQGMKRSVWSNLKRAAT

SEQ ID NO: 29115 - protein, 892 aa, Homo sapiens
MEPSLGQGMDLTCPFGVSPACGAQASWSIFGADAAEVPGTRGHSQQEAAMPHIPEDEEPPGEPQAAQSPAGQQGPPTAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPEGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 29116 - protein, 803 aa, Homo sapiens
MTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPEGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 29117 - protein, 200 aa, Homo sapiens
MDSSTAHSPVFLVFPPEITASEYESTELSATTFSTQSPLQKLFARKMKILGTIQILFGIMTFSFGVIFLFTLLKPYPRFPFIFLSGYPFWGSVLFINSGAFLIAVKRKTTETLIILSRIMNFLSALGAIAGIILLTFGFILDQNYICGYSHQNSQCKAVTVLFLGILITLMTFSIIELFISLPFSILGCHSEDCDCEQCC

SEQ ID NO: 29118 - protein, 147 aa, Homo sapiens
MTSQPISNETIIMLPSNVINFSQAEKPEPTNQGQDSLKKRLQAKVKVIGVHSSLAGSILSALSALVGFILLSVNPAALNPASLQCKLDEKDIPTRLLLSYDYHSPYTMDCHRAKASLAGTLSLMLVSTVLEFCLAVLTAVLQWKQTV

SEQ ID NO: 29119 - protein, 570 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAAVESIPVFGALCSSSSLHQTLEALARDLTKLDLRRWASFMDAGVEHDDVAELLQELQSLAQCYQGGDSLVD

SEQ ID NO: 29120 - protein, 508 aa, Homo sapiens
MEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSDVPKPMTALVGRFLPASTKLNLITQQLEGALPSVVNGSAFPSGSTLPGPPKITLAGYCDCFASGDFCNNCNCNNCCNNLHHDIERFKAIKACLGRNPEAFQPKIGKGQLGNVKPQHNKGCNCRRSGCLKNYCECYEAQIMCSSICKCIGCKNYEESPERKTLMSMPNYMQTGGLEGSHYLPPTKFSGLPRFSHDRRPSSCISWEVVEATCACLLAQGEEAEKEHCSKCLAEQMILEEFGRCLSQILHTEFKSKGLKME

SEQ ID NO: 29121 - protein, 245 aa, Homo sapiens
MTLVILLVELGGSQARFPLFWRNFPITFACYAALLCLSASIIYPTTYLQFLSHGRSRDHAIAAIVFSGIACVAYATEVTWTRARPGEITDYMASELGLLKVLETFVACLIFVFINSPYVYHNRPALEWCVAVYALCFVLAALTVLLSLGHCTNMLPIRFPSFLLGLALLSVLLYATALVLWPLYQFNEKYGVQPWQTRDVSCSDRNPYLVCIWDRRLAVTNLTAVNLLAYVGDLVYSAHLVFVKV

SEQ ID NO: 29122 - protein, 947 aa, Homo sapiens
  VARIANT 543: Xaa = Any Amino Acid
MVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVXEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPVGKAGKEERKGAAQEKKQLGIKDKEDKKGAKLLGKEDRPNSKKHKAKDDKKVIKSASQDRFSLEDPTPDIILSSQEPIDPLVMGKYTQSLHSEVRGLLDTLVTDLMVLADELSPIKNVEEALRLCR

SEQ ID NO: 29123 - protein, 215 aa, Homo sapiens
MPGEATETVPATEQELPQSQAETGSGTASDSGESVPGIEEQDSTQTTTQKAWLVAAAEIDEEPVGKAKQSRSEKRARKAMSKLGLLQVTGVTRVTIWKSKNILFVITKLDVYKSPASDAYIVFGEAKIQDLSQQAQLAAAEKFRVQGEAVGNIQENTQTPTVQEESEEEEVDETGVEVKDVKLVMSQANVSRAKAVRALKNNSNDIVNAIMELTV

SEQ ID NO: 29124 - protein, 660 aa, Homo sapiens
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKLVKTLVADTPLTAVDFMPDGATLAIGSSRGKIYQYDLRMLKSPVKTISAHKTSVQCIAFQYSTVLTKSSLNKGCSNKPTTVNKRSVNVNAASGGVQNSGIVREAPATSIATVLPQPMTSAMGKGTVAVQEKAGLPRSINTDTLSKETDSGKNQDFSSFDDTGKSSLGDMFSPIRDDAVVNKGSDESIGKGDGFDFLPQLNSVFPPRKNPVTSSTSVLHSSPLNVFMGSPGKEENENRDLTAESKKIYMGKQESKDSFKQLAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFREACHRDIVNLQVEMIKQFHMQLNEMHSLLERYSVNEGLVAEIERLREENKRLRAHF

SEQ ID NO: 29125 - protein, 500 aa, Homo sapiens [sequence omitted]

SEQ ID NO: 29126 - protein, 1436 aa, Homo sapiens
MLHLSAAPPAPPPEVTATARPCLCSVGRRGDGGKMAAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSELVVDSQMQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVYDRPGASPKRNHDGECTAAPTNRQIEILELEDLEKECSLARIRLTLAQHDPSAVAVAGSSSAEEMVTLLVQAGLFDTAISLCQTFKLPLTPVFEGLAFKCIKLQFGGEAAQAEAWAWLAANQLSSVITTKESSATDEAWRLLSTYLERYKVQNNLYHHCVINKLLSHGVPLPNWLINSYKKVDAAELLRLYLNYDLLEEAVDLVSEYVDAVLGKGHQYFGIEFPLSATAPMVWLPYSSIDQLLQALGENSANSHNIALSQKILDKLEDYQQKVDKATRDLLYRRTL

SEQ ID NO: 29127 - protein, 1591 aa, Homo sapiens
MVQGRVTEVKFPLEHYILELQDHRVALNGSHSEKVAILDDKTAMVTASQLGQTNLVFVHKNVHMRSVSGLPNCTIYVVEPGFLGFTVQPGNRWSLEVGQVYVITVDVFDKSSTKVYISDNLRITYDFPKEYFEEQLTTVNGSYHIVKALKDGVVVINASLTSIIYQNKDIQPIKFLIKHQQEVKIYFPIMLTPKFLAFPHHPMGMLYRYKVQVEGGSGNFTWTSSNETVVIVTTKGVVTAGQVRGNSTVLARDVQNPFRYGEIKIHVLKLNKMELLPFHADVEIGQIIEIPIAMYHINKETKEAMAFTDCSHLSLDLNMDKQGVFTLLKEGIQRPGPMHCSSTHIAAKSLGHTLVTVSVNECDKYLESSATFAAYEPLKALNPVEVALVTWQSVKEMVFEGGPRPWILEPSRFFLELNAEKTEKIGIAQVWLPSKRKQNQYIYRIQCLDLGEQVLTFRIGNHPGVLNPSPAVEVLQVRFICAHPASMSVTPVYKVPAGAQPCPLPQHNKWLIPVSRLRDTVLELAVFDQHRRKFDNFSSLMLEWKSSNETLAHFEDYKSVEMVAKDGGSGQTRLHGHQILKVHQIKGTVLIGVNFVGYSEKKSPKEISNLPRSVDVELLLVDDVTVVPENATIYNHPDVKETFSLVEGSGYFLVNSSEQGVVTITYMEAESSVELVPLHPGFFTLEVYDLCLAFLGPATAHLRVSDIQELELDLIDKVEIDKTVLVTVRVLGSSKRPFQNKYFRNMELKLQLASAIVTLTPMEQQDEYSENYILRATTIGQTTLVAIAKDKMGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKGVYVCIIKVRPQSEELLQALSVADTSVYGWATLVSERSKNGMQRILIPFIPAFYINQSELVLSHKQDIGEIRVLGVDRVLRKLEVISSSPVLVVAGHSHSPLTPGLAIYSVRVVNFTSFQQMASPVFINISCVLTSQSEAVVVRAMKDKLGADHCEDSAILKRFTGSYQILLLTLFAVLASTASIFLAYSAFLNKIQTVPVVYVPTLGTPQPGFLTPQVLPLTS

SEQ ID NO: 29128 - protein, 2090 aa, Homo sapiens
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 29129 - protein, 522 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 29130 - protein, 522 aa, Homo sapiens; identical to SEQ ID NO: 29129

SEQ ID NO: 29131 - protein, 522 aa, Homo sapiens; identical to SEQ ID NO: 29129

SEQ ID NO: 29132 - protein, 522 aa, Homo sapiens; identical to SEQ ID NO: 29129

SEQ ID NO: 29133 - protein, 2367 aa, Homo sapiens
MSSPRLIPLWKDLKLLLNDTINKSKQPSEDPKNCLIVLSDRSQAVAWMKSKTEDMVEKRTFSMTERLPPIQSMVHAGSFHILVVYCGDLILRLFGDHFRAFKPLGKVPCRFNISCLCYDPEMKMLLSGILGAVVTWVIELGGTGLQIAHMVSMPGDELVQDIVLNGPSGSLLALCETVVRVLMHQGKGQLGEVKRFTSTSSGSSITCCFTCFDQGFLYAGNQAGEIQVWSLQQGHPLHSFQAHQSGVICIRSRPEAHTLLTAGSDSLIKEWNLTSGSLLRRLELGEELYRLQFIDSITFFCQTAHSFSLHRLPCFYSLFNVCGSAPQQLRRVCCGNNWFRILCTTEDGLLRFVSPVTGDLLVITWPFSILDQAVDWAYDPGKEELFVATGSSEVLVFDTTRCPCPAKYLLGTSPNSQDFVQCLAYGHFNLGRGLEGLIFSGHQSGVIRVLSQHSCARLEKFMHFGAVLALSTLSGGIFGGQGNSLLCSYGMDDYVHLSEAVLDGVKVQLRPLASILSSCHLTHLILLPKSVGAITETNCLRLWKFHDFLSSGSQNGLKFIETLPLHLCAITSFDVCLSLSLFVTGSADGSVRIWDFHGRLIGILDSSLHFGPVCFANDRGDLLVTFNQSLYLVSCLKLLPPALLTRLSFMSISDEVLEVPKPFIPSFFFSFETMFVPKYIYPGQAQQKLVGLEKLVNNRAIAFDHSVPHVIEEDEEGSPVLLRSSMHYSLQDMEDWMQVSKRYQCHYVLPPQLQLTSWDGLNPYQILRYYFGHGREWLFAPDCYIPNSVIRARLWPEGTPIYLQCNLHAPQRELEWDRSQEFFFWHSRVRAISNTEYPKNKEEDEHFLEMRLSKDVTYSVLTDGANRSWLGRKMSEITINSMIETMLNIMVHASLLKYQCCVGALGQIFASYQVSPALRSETARRLLNDTTNSNPLIRELAWEGLKRLGMITHLFAMPLAQGLMDKDERVRIKTLSLMAEIGIHSRTSLLQLTQKQETFREMQQQMIGEEPLDHLLGMRATDLQILSTQVEQRLNENLTLSHRDEKPAFSLDVSMPSELKSSLKPPTVSEESEVAIKPSKGQRRGQAGVKKHSQKWLRGLKKTKERDSKQMSTEPGLLEDESGTEAAPIEMEEASVYSQWSSSTSVIKLSKDVDSQEKDISKDHIALTLKRLQKIRDKRDKKATAQKLKKKHKKKGKEAKVINEETTPPVMEQPVTKKVKIQGRGASGISGRRSTAGDGSSWRDDLCRLMALRISGSQTKMSENLNAELVTFAQEMLVDRHPSWELFQEICPLLKKESKVLLEDLDWDVVPPEKKPIFIQEGAIREDMIQGVTQEVIRHKEVMPREEEQAQKKARDMLGLEETQVILKKGKKVIFLEPGNVTMGKEISKKEEKKTFQKSPKQGRKAVQKERKVGKIKREMTKEERDMSEEVEEMATLEEKVVKQEGKLVMIERTPSWQDWKKAWDEWKQVHGETRKSWKAWKEEWEKRLLQEEEKLHQAGEKLSPEEEMLQEDKKLKWEEWKQVWENMLSSKSKEQQYKDEEEVTLEEEVSREGEEKEQQKVEELPQREQNLDWQEKELAQELEELEWDMEELSWKEEELNQEEGKLVEEKKKLAEEEEALAWQREKLSEEETKLAQEEELLIQEKEKLAQHKEKMPEEEERLGRKREQLIEKKMKLAQKRERWINSMEELTKNKMILYQKKNLAQEKKNLAQEKEKLAQRKENLLYNKERLTHSKKQLVQVKNKLGMFNKILAQVEEKLTQEKETVIKKKEKLAETEKKLVQVEDSLAKKQEKLAQEKMKLALEKAMVQGKKRLRGELDIAKEEKALNLEMKRLAEEKMRLVEGKETLSKGETPETSRQRKMTQVEQELFERKLSLEEKILLHEDRILAMEESEIAKGKLEFTRGQRIFVQGQRKLAKASRKLIKKRESLSKEPAKLNKILKALQKLTRDERKLTQEEIKMTKMKRALFVKERRLSIEQSKLDIKEWDFSEKRSELTKDEKKLARKQRKLANKMRRMINKEEKMTEEESKLARKHSEVILDDEEEGGIEEEEGNLEWLHLAKHEAIVYRHRQALESQDTRISSRQSMSPKYLKVIPPIKAKEKESWPKPLAVPTQKSPLATKRIPDPRAKNWHLLGEPYRSERAQQISIAHKEMEMQYFYPATRDIFPSAHASVEKQTLALMFQKDFWDFKDKRRFPKLPKLEKKTQPISKKKEELPLWETFVALYHVLRMLQQRYPKDSTAWMEQFYQLMDLYQLKSPRIQKLLQELLMREEPQPQEIIYEEALKATELVPGERLFCCLFCGSSHTPRSPQEFQGAVPLPWQNCVRTILPVGIARYGILELAWKSLPEADLHLTKALTHTVAPTL

SEQ ID NO: 29134 - protein, 466 aa, Homo sapiens
MTTLPPLPMTRPKLTALARQKLPCSSRKIPRSQLIKEKDDIDHYLEVNFKGLSKEEVAAYRNSYKKNICVDMLRDGYHKSFTELFALMERWDALREAARVRSLFWLQKPLEEQPDKLDYLYHYLTRAEDAERKESFEDVYNNLYALACYFNNSEDKWVRNHFYERCFKIAQLIKIDCGKKEAEAHMHMGLLYEEDGQLLEAAEHYEAFHQLTQGRIWKDETGRSLNLLACESLLRTYRLLSDKMLENKEYKQAIKILIKASEIAKEGSDKKMEAETSYYLGLAHLAAEEYETALTVLDTYCKISTDLDDDLSLGRGYEAIAKVLQSQGEMTEAIKYLKKFVKIARNNFQSLDLVRASTMLGDIYNEKGYYNKASECFQQAFDTTVELMSMPLMDETKVHYGIAKAHQMMLTVNNYIESADLTSLNYLLSWKESRGNIEPDPVTEEFRGSTVEAVSQNSERLEELSR

SEQ ID NO: 29135 - protein, 344 aa, Homo sapiens
MLSSFPHRKTWRKSKKTVKVTRSYPTFPSLNAWEEFRGLLPVDGEPNPGAGLGVEEGLLCRVVHSPEFNLFLDSVVFESNFIQVKRGRNWRDVYKASNTMALGVTSSVPCLPLPNILLMASVKWHQGQNQTWNRPSIAPNIFLKRILPLRFVELQVCDHYQRILQLRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLSFRSSRKVETNKNSSGKDSSREDSIPCTCDLRWRASFTYGEWERENPSGLQPLSLLSTLAASTGPQLAPPIGNSI

SEQ ID NO: 29136 - protein, 250 aa, Homo sapiens
MAALSCLLDSVRRDIKKVDRELRQLRCIDEFSTRCLCDLYMHPYCCCDLHPYPYCLCYSKRSRSCGLCDLYPCCLCDYKLYCLRPSLRSLERKAIRAIEDEKRELAKLRRTTNRILASSCCSSNILGSVNVCGFEPDQVKVRVKDGKVCVSAERENRYDCLGSKKYSYMNICKEFSLPPCVDEKDVTYSYGLGSCVKIESPCYPCTSPCSPCSPCNPCNPCSPCNPCSPYDPCNPCYPCGSRFSCRKMIL

SEQ ID NO: 29137 - protein, 805 aa, Homo sapiens
MKDRSSTPPLHVHVDENTPVHVHIKKLPKPSATSSQKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 29138 - protein, 638 aa, Homo sapiens
MSASSSGGSPRFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 29139 - protein, 254 aa, Homo sapiens
MTEEVWMGTWRPHRPRGPIMALYSSPGPKYLIPPTTGFMKHTPTKLRAPAYSFRGAPMLLAENCSPGPRYNVNPKILRTGKDLGPAYSILGRYQTKTMLTPGPGDYFPEKSTKYVFDSAPSHSISARTKAFRVDSTPGPAAYMLPMVMGPNTVGKASQPSFSIKGRSKLGGFSDDLHKTPGPAAYRQTDVRVTKFKAPQYTMAARVEPPGDKTLKPGPGAHSPEKVTLTKPCAPVVTFGIKHSDYMTPLLVDVE

SEQ ID NO: 29140 - protein, 229 aa, Homo sapiens
MAAQPLRHRSRCATPPRGDFCGGTERAIDQASFTTSMEWDTQVVKGSSPLGPAGLGAEEPAAGPQLPSWLQPERCAVFQCAQCHAVLADSVHLAWDLSRSLGAVVFSRVTNNVVLEAPFLVGIEGSLKGSTYNLLFCGSCGIPVGFHLYSTHAALAALRGHFCLSSDKMVCYLLKTKAIVNASEMDIQNVPLSEKIAELKEKIVLTHNRLKSLMKILSEVTPDQSKPEN

SEQ ID NO: 29141 - protein, 318 aa, Homo sapiens
MDKINQTFVREFILLGLSGYPKLEIIFFALILVMYVVILIGNGVLIIASILDSRLHMPMYFFLGNLSFLDICYTTSSIPSTLVSLISKKRNISFSGCAVQMFFGFAMGSTECFLLGMMAFDRYVAICNPLRYPIIMNKVVYVLLTSVSWLSGGINSTVQTSLAMRWPFCGNNIINHFLCEILAVLKLACSDISVNIVTLAVSNIAFLVLPLLVIFFSYMFILYTILRTNSATGRHKAFSTCSAHLTVVIIFYGTIFFMYAKPKSQDLLGKDNLQATEGLVSMFYGVVTPMLNPIIYSLRNKDVKAAIKYLLSRKAINQ

SEQ ID NO: 29142 - protein, 316 aa, Homo sapiens
MKIANNTVVTEFILLGLTQSQDIQLLVFVLILIFYLIILPGNFLIIFTIRSDPGLTAPLYFFLGNLAFLDASYSFIVAPRMLVDFFSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSMCTTRVIIILLMFGPAIFIYMCPFRALPADKMVSLFHTVIFPLMNPMIYTLRNQEVKTSMKRLLSRHVVCQVDFIIRN

SEQ ID NO: 29143 - protein, 313 aa, Homo sapiens
MLARNNSLVTEFILAGLTDHPEFRQPLFFLFLVIYIVTMVGNLGLITLFGLNSHLHTPMYYFLFNLSFIDLCYSSVFTPKMLMNFVSKKNIISNVGCMTRLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGTNITVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 29144 - protein, 577 aa, Homo sapiens
MSKPELKEDKMLEVHFVGDDDVLNHILDREGGAKLKKERAQLLVNPKKIIKKPEYDLEEDDQEVLKDQNYVEIMGRDVQESLKNGSATGGGNKVYSFQNRKHSEKMAKLASELAKTPQKSVSFSLKNDPEITINVPQSSKGHSASDKVQPKNNDKSEFLSTAPRSLRKRLIVPRSHSDSESEYSASNSEDDEGVAQEHEEDTNAVIFSQKIQAQNRVVSAPVGKETPSKRMKRDKTSDLVEEYFEAHSSSKVLTSDRTLQKLKRAKLDQQTLRNLLSKVSPSFSAELKQLNQQYEKLFHKWMLQLHLGFNIVLYGLGSKRDLLERFRTTMLQDSIHVVINGFFPGISVKSVLNSITEEVLDHMGTFRSILDQLDWIVNKFKEDSSLELFLLIHNLDSQMLRGEKSQQIIGQLSSLHNIYLIASIDHLNAPLMWDHAKQSLFNWLWYETTTYSPYTEETSYENSLLVKQSGSLPLSSLTHVLRSLTPNARGIFRLLIKYQLDNQDNPSYIGLSFQDFYQQCREAFLVNSDLTLRAQLTEFRDHKLIRTKKGTDGVEYLLIPVDNGTLTDFLEKEEEEA

SEQ ID NO: 29145 - protein, 153 aa, Homo sapiens
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 29146 - protein, 1048 aa, Homo sapiens
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCKSKTAAAAADVNGFKPLSGNELKNNGNSTSLPLSRKVLKSLNPAVYRNVEYEIWLKSKQAQQKRDYSIAAGLQYEVGDKCQVRLDHNGKFLNADVQGIHSENGPVLVEELGKKHTSKNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRKSSHVGDRKGSRRRMDTEERKDKDSIHGHSQLDKRPEPSTLENITDDKYATVSSPSKSKKLECPSPAEQKPAEHVSLSNPAPLLVSPEVHLTPAVPSLPATVPAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 29147 - protein, 267 aa, Homo sapiens
MPRAFLVKKPCVSTCKRNWSELPDEERGEIYVPVSLGFCPPQPYREPEPSVAEPPSCPLALNMSLRDSSYSMAPGPCVVAQLPSEDMGHLTDPQSRDHGFLRTKMKVTLGDSPSGDLFTCRVCQKAFTYQRMLNRHMKCHNDVKRHLCTYCGKGFNDTFDLKRHVRTHTGVRPYKCSLCDKAFTQRCSLESHLKKIHGVQQKYAYKERRAKLYVCEECGCTSESQEGHVLHLKEHHPDSPLLRKTSKKVAVALQNTVTSLLQGSPHL

SEQ ID NO: 29148 - protein, 1394 aa, Homo sapiens
MTGSHLSHDSWQYVLLIPSVLQEGSLDKACAQLFNLTESVVLTVSLNYGEVQTKIFEENVTGENFFKCISFEVPQARSDPLAFITFSAKGATLNLEERRSVAIRSRENVVFVQTDKPTYKPGQKDVNGIAQFFLDTYTFTYPNITLKDPQNNRIFQWQNVTSFRNITQLSFQLISEPMFGDYWIVVKRNSRKTVTHQFAVKRYVLPKFEVTVNAPQTVTISDDEFQVDVCAKYTFGQPVQGKTQIRVCREYFSSSNCEKNDNEICEQFIAQLENGCVSQIVNTKVFQLYRSGLFMTFHVAVIVTEFGTGNYCMQISEKTSVFITQLLGTVNFENMDTFYRRGISYFGTLKFSDPNNVPMVNKLLQLELNDEFIGNYTTDENGEAQFSIDTSDIFDPEFNLKATYVRPKSCYLPSWLTPQYLDAHFLVSRFYSRTNSFLKIVPEPKQLECNHQKVVTVHYSLNSEAYEDDSNVKFFYLVSLSHDSGNFQHRISSSPIYTAWNGNFSFPLSISADLAPAAVLFVYTLHPSGEIVADSVRFQVDKCFKHKVNIKFSNEQGLPGSNASLYLQAAPVLFCALGAVDGNVLLLKSEQQLSAESVYNMVPSIEPYGYFYHGLNLDDGKEDPCIPQRDMFYNGLYYTPVSNYGDGDIYNIVRNMGLKVFTNLHYRKPEVCVMERRLPLPKPLYLETENYGPMHSVPSRIACRGENADYVEQAIIQTVRTNFPETWMWDLVSVDSSGSANLSFLIPDTITQWEASGFCVNGDVGFGISSTTTLEVSQPFFIEIASPFSVVQNEQFDLIVNAFSYLNTCVEISVQVEESQNYEANINTWKINGSEVIQAGGRKTNIWTIIPKKLGKVNITVVAESKQSSACPNEGMEQQKLNWKDTVVKSFLVEPEGIEKERTQSFLICTEGAKASKQGVLDLPNDVVEGSARGFFTVVGDILGLAMQNLVVLQMPYGGGEQNAALLASDTYVLDYLKSTEQLTEEVQSKAFFLLSNGYQRQLSFKNSDGSYSVFWQQNQKGSIWLSALTFKTLERMKKFVFIDENVQKQTLIWLSSQQKTSGCFKNDGQLFNHAWEGGDEEDISLTAYVVGMFFEAGLNSTFPALRNALFCLEAALDSGVTNGYNHAILAYAFALAGKEKQVESLLQTLDQSATKLNNVIYWERERKPKTEEFPSFIPWAPSAQTEKSCYVLLAVISRKIPDLTYASKIVQWLAQQMNSHGGFSSNQVINVGLILIAICGEEGLFSKNQNTVTFSSEGSSEIQFNGHNRLLVQRSEVTQAPGQYTVDVEGRGCTFIQATLKYNVLLPKKASGFSLSLEIVKNYSLTVFDLTVNLKYTGIRNKSSMVVIDVKMLSGFTPTMSSIEEVNNRSLIFHHKDSYIEYKDKINTCLAVV

SEQ ID NO: 29149 - protein, 138 aa, Homo sapiens
MVNKLLQLELNDEFIGNYTTDENGEAQFSIDTSDIFDPEFNLKATYVRPESCYLPSWLTPQYLDAHFLVSRFYSRTNSFLKIVPEPKQLECNHQKVVTVHYSLNSEAYEDDSNVKFFYLMMVKGAILLSGQKEIRNKG

SEQ ID NO: 29150 - protein, 517 aa, Homo sapiens
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGAFPPEDIHVPNIYVDRVIKGQKYEKRIERLTILKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKELTLRELWEGLTVDDIKKSTGCAFAVSPNLRPMQQVAP

SEQ ID NO: 29151 - protein, 631 aa, Homo sapiens
MNPSTPSYPTASLYVGDLHPDVTEAMLYEKFSPAGPILSIRICRDLITSGSSNYAYVNFQHTKDAEHALDTMNFDVIKGKPVRIMWSQRDPSLRKSGVGNIFVKNLDKSINNKALYDTVSAFGNILSCNVVCDENGSKGYGFVHFETHEAAERAIKKMNGMLLNGRKVFVGQFKSRKEREAELGARAKEFPNVYIKNFGEDMDDERLKDLFGKFGPALSVKVMTDESGKSKGFGFVSFERHEDAQKAVDEMNGKELNGKQIYVGRAQKKVERQTELKRTFEQMKQDRITRYQVVNLYVKNLDDGIDDERLRKAFSPFGTITSAKVMMEGGRSKGFGFVCFSSPEEATKAVTEMNGRIVATKPLYVALAQRKEERQAYLTNEYMQRMASVRAVPNQRAPPSGYFMTAVPQTQNHAAYYPPSQIARLRPSPRWTAQGARPHPFQNKPSAIRPGAPRVPFSTMRPASSQVPRVMSTQRVANTSTQTVGPRPAAAAAAAATPAVRTVPRYKYAAGVRNPQQHRNAQPQVTMQQLAVHVQGQETLTASRLASAPPQKQKQMLGERLFPLIQAMHPTLAGKITGMLLEIDNSELLYMLESPESLRSKVDEAVAVLQAHQAKEATQKAVNSATGVPTV

SEQ ID NO: 29152 - protein, 111 aa, Homo sapiens
MSEHVRTRSQSSERGNDQESSQPVGSVIVQEPTEEKRQEEEPPTDNQGIAPSGEIENEGAPAVQGPDMEAFQQELALLKIEDEPGDGPDVREGIMPTFDLTKVLEAGDAQP

SEQ ID NO: 29153 - protein, 479 aa, Homo sapiens
MSDGFDRAPGAGRGRSRGLGRGGGGPEGGGFPNGAGPAERARHQPPQPKAPGFLQPPPLRQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 29154 - protein, 400 aa, Homo sapiens
MSDGFDRAPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 29155 - protein, 367 aa, Homo sapiens
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 29156 - protein, 637 aa, Homo sapiens
MMPFPVTTQGPPQPAPPPNRYGVSSPISLAVPKETDCLLTQRLIETLRPFGVFEEEEELQRRILVLEKLNNLVKEWIREISESKSLPQSVIENVGGKIFTFGSYRLGVHTKGADIDALCVAPSHVDRSDFFTSFYAKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKCHNIYSNILGFLGGVSWAMLVARTCQLYPNAVASTLVRKFFLVFSEWEWPNPVLLKEPEERNLNLPVWDPRVNPSDRYHLMPIITPAYPQQNSTYNVSISTRMVMIEEFKQGLAITHEILLSKAEWSKLFEAPSFFQKYKHYIVLLASASTEKQHLEWVGLVESKIRILVGSLEKNEFITLAHVNPQSFPAPKENPDMEEFRTMWVIGLGLKKPDNSEILSIDLTYDIQSFTDTVYRQAVNSKMFEMGMKITAMHLRRKELHQLLPHHVLQDKKAHSTEGRRLTDLNDSSFDLSAGCENSMSVPSSTSTMKTGPLISSSQGRNSPALAVMTASVANIQATEFSLQQVNTNESSGVALNESIPHAVSQPAISPSPKAMVARVVSSTCLISHPDLQETQQQTYLIL

SEQ ID NO: 29157 - protein, 269 aa, Homo sapiens
MHQKLLKSAHYIELGSYQYWPVLVPRGIRLYTYEQIPGSLKDNPYITDGYRAYLPSRLCIKSLFILSNETVNIWSHLLGFFLFFTLGIYDMTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPESLPR

SEQ ID NO: 29158 - protein, 346 aa, Homo sapiens
MAMAQKLSHLLPSLRQVIQEPQLSLQPEPVFTVDRAEVPPLFWKPYIYAGYRPLHQTWRFYFRTLFQQHNEAVNVWTHLLAALVLLLRLALFVETVDFWGDPHALPLFIIVLASFTYLSFSALAHLLQAKSEFWHYSFFFLDYVGVAVYQFGSALAHFYYAIEPAWHAQVQAVFLPMAAFLAWLSCIGSCYNKYIQKPGLLGRTCQEVPSVLAYALDISPVVHRIFVSSDPTTDDPALLYHKCQVVFFLLAAAFFSTFMPERWFPGSCHVFGQGHQLFHIFLVLCTLAQLEAVALDYEARRPIYEPLHTHWPHNFSGLFLLTVGSSILTAFLLSQLVQRKLDQKTK

SEQ ID NO: 29159 - protein, 377 aa, Homo sapiens
MPRRLQPRGAGTKGPPAPAPAASGAARNSHSAASRDPPASAKPLLRWDEVPDDFVECFILSGYRRLPCTAQECLASVLKPTNETLNFWTHFIPLLLFLSKFCRLFFLSGGDVPFHHPWLLPLWCYASGVLLTFAMSCTAHVFSCLSLRLRAAFFYLDYASISYYGFGSTVAYYYYLLPGLSLLDARVMTPYLQQRLGWHVDCTRLIAAYRALVLPVAFVLAVACTVACCKSRTDWCTYPFALRTFVFVMPLSMACPIMLESWLFDLRGENPTLFVHFYRRYFWLVVAAFFNVSKIPERIQPGLFDIIGHSHQLFHIFTFLSIYDQVYYVEEGLRQFLQAPPAAPTFSGTVGYMLLLVVCLGLVIRKFLNSSEFCSKK

SEQ ID NO: 29160 - protein, 773 aa, Homo sapiens
MKMRGEKRRDKVNPKSSQRKLNWIPSFPTYDYFNQVTLQLLDGFMITLSTDGVIICVAENISSLLGHLPAEIVGKKLLSLLPDEEKDEVYQKIILKFPLLNSETHIKFCCHLKRGNVEHGDSSAYENVKFIVNVRDICNEFPVVFSGLFSSHLCADFAACVPQEDRLYLVGNVCILRTQLLQQLYTSKAVSDEAVLTQDSDEEPFVGELSSSQGQRGHTSMKAVYVEPAAAAAAAAISDDQIDIAEVEQYGPQENVHMFVDSDSTYCSSTVFLDTMPESPALSLQDFRGEPEVNPLYRADPVDLEFSVDQVDSVDQEGPMDQQDPENPVAPLDQAGLMDPVDPEDSVDLGAAGASAQPLQPSSPVAYDIISQELELMKKLKEQLEERTWLLHDAIQNQQNALELMMDHLQKQPNTLRHVVIPDLQSSEAVPKKQQKQHAGQVKRPLPHPKDVKCFCGLSLSNSLKNTGELQEPCVAFNQQQLVQQEQHLKEQQRQLREQLQQLREQRKVQKQKKMQEKKKLQEQKMQEKKKLQEQRRQKKKKLQERKKWQGQMLQKEPEEEQQKQQLQEQPLKHNVIVGNERVQICLQNPRDVSVPLCNHPVRFLQAQPIVPVQRAAEQQPSGFYQDENCGQQEDESQSFYPEAYQGPPVNQLPLIDTSNSEAISSSSIPQFPITSDSTISTLETPQDYIRLWQELSDSLGPVVQVNTWSCDEQGTLHGQPTYHQVQVSEVGVEGPPDPQAFQGPAAYQPDQMRSAEQTRLMPAEQRDSNKPC

SEQ ID NO: 29161 - protein, 322 aa, Homo sapiens
MEGISNFKTPSKLSEKKKSVLCSTPTINIPASPFMQKLGFGTGVNVYLMKRSPRGLSHSPWAVKKINPICNDHYRSVYQKRLMDEAKILKSLHHPNIVGYRAFTEANDGSLCLAMEYGGEKSLNDLIEERYKASQDPFPAAIILKVALNMARGLKYLHQEKKLLHGDIKSSNVVIKGDFETIKICDVGVSLPLDENMTVTDPEACYIGTEPWKPKEAVEENGVITDKADIFAFGLTLWEMMTLSIPHINLSNDDDDEDKTFDESDFDDEAYYAALGTRPPINMEELDESYQKVIELFSVCTNEDPKDRPSAAHIVEALETDV

SEQ ID NO: 29162 - protein, 807 aa, Homo sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNVSPTFEFWL

SEQ ID NO: 29163 - protein, 844 aa, Homo sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKVGYYVFIFLLCFMNNIFSYRIFSNMYQNISFLSTFHLCLNISSDTFVI

SEQ ID NO: 29164 - protein, 810 aa, Homo sapiens
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVNVYLIIAICVVSSLLVLTLLLYTALWWSATPTEGACAPGKPTLVCSRAVGSWSYSQQRRQRVCSEEGPPKTDLMAFSPSLPLGLNKEEEGERQEPGSNHPGQVSFLQIPPIRKCM

SEQ ID NO: 29165 - protein, 792 aa, Homo sapiens
MVIIGPRGPGSQRLLLSLLLLAAWEVGSGQLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDINVYLIIAICAVSSLLVLTLLLYTALRCSAPPTVSRCAPGKPTLVCSSAVGSWSYSQQRRQRVCSAESPPKTDLMAFSPSLQLSREDCLNPPSEVSY

SEQ ID NO: 29166 - protein, 807 aa, Homo sapiens
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEVSLYFKKLS

SEQ ID NO: 29167 - protein, 824 aa, Homo sapiens
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKVSLLLFLANSKIVLFKKFYMISTSYLDS

SEQ ID NO: 29168 - protein, 808 aa, Homo sapiens
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKIWNFNLQIQLAS

SEQ ID NO: 29169 - protein, 824 aa, Homo sapiens
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKVSNFYLFFPKCLCFSFLNVSTPLEIH

SEQ ID NO: 29170 - protein, 798 aa, Homo sapiens
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKVSV

SEQ ID NO: 29171 - protein, 816 aa, Homo sapiens
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNVSFLILTSIFPSQFSNIKCHIHPLFLYLKIMS

SEQ ID NO: 29172 - protein, 803 aa, Homo sapiens
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVNVYLIIAICAVSSLLVLTLLLYTALRCSAPPTEGACTADKPTLVCSSAVGSWSYSQQRRQRVCSGEGPPKMDLMAFSPSLSPCPIMMGKAENQDLNEDHDAKVSEFS

SEQ ID NO: 29173 - protein, 789 aa, Homo sapiens
MVCPNGYDPGGRHLLLFIIILAAWEAGRGQLHYSVPEEAKHGNFVGRIAQDLGLELAELVPRLFRAVCKFRGDLLEVNLQNGILFVNSRIDREELCGRSAECSIHLEVIVERPLQVFHVDVEVKDINDNPPVFPATQRNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTLTSLSLPIPEDAQPGTVITLISVFDRDFGVNGQVTCSLTPRVPFKLVSTFKNYYSLVLDSALDRESVSAYELVVTARDGGSPSLWATASVSVEVADVNDNAPAFAQPEYTVFVKENNPPGCHIFTVSAGDADAQKNALVSYSLVELRVGERALSSYVSVHAESGKVYALQPLDHEELELLQFQVSARDAGVPPLGSNVTLQVFVLDENDNAPALLAPRVGGTGGAVRELVPRSVGAGHVVAKVRAVDADSGYNAWLSYELQPVAAGASIPFRVGLYTGEISTTRALDETDAPRHRLLVLVKDHGEPSLTATATVLVSLVESGQAPKASSRASLGIAGPETELVDVNVYLIIAICAVSSLLVLTLLLYTALRCSAPSSEGACSLVKPTLVCSSAVGSWSFSQQRRQRVCSGEGPPKTDLMAFSPSLPQGPSSTDNVSHK

SEQ ID NO: 29174 - protein, 814 aa, Homo sapiens
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVNVYLIIAICAVSSLLVLTLLLYTALRCSALPTEGGCRAGKPTLVCSSAVGSWSYSQQQPQRVCSGEGPPKTDLMAFSPCLPPDLGSVDVGEEQDLNVDHGLKVSPFKFRTHKFYLWKL

SEQ ID NO: 29175 - protein, 842 aa, Homo sapiens
MLYSSRGDPEGQPLLLSLLILAMWVVGSGQLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTLLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVNVYLIIAICAVSSLLVLTLLLYTVLRCSAMPTEGECAPGKPTLVCSSAVGSWSYSQQRRQRVCSGEGKQKTDLMAFSPGLSPCAGSTERTGEPSASSDSTGKVGFSSILFIYIIFFLERYYRLLPGAVQIVLFIFLEIQQIFFLIK

SEQ ID NO: 29176 - protein, 818 aa, Homo sapiens
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMVSKFYGI

SEQ ID NO: 29177 - protein, 884 aa, Homo sapiens
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEVRQWSGGLLQTHAFVTHPPISCDLALLSH

SEQ ID NO: 29178 - protein, 796 aa, Homo sapiens
MEAGGERFLRQRQVLLLFVFLGGSLAGSESRRYSVAEEKEKGFLIANLAKDLGLRVEELAARGAQVVSKGNKQHFQLSHQTGDLLLNEKLDREELCGPTEPCILHFQILLQNPLQFVTNELRIIDVNDHSPVFFENEMHLKILESTLPGTVIPLGNAEDLDVGRNSLQNYTITPNSHFHVLTRSRRDGRKYPELVLDKALDREEQPELSLTLTALDGGSPPRSGTAQINIQVLDINDNAPEFAQPLYEVAVLENTPVNSVIVTVSASDLDTGSFGTISYAFFHASEEIRKTFQLNPITGDMQLVKYLNFEAINSYEVDIEAKDGGGLSGKSTVIVQVVDVNDNPPELTLSSVNSPIPENSGETVLAVFSVSDLDSGDNGRVMCSIENNLPFFLKPSVENFYTLVSEGALDRETRSEYNITITITDLGTPRLKTKYNITVLVSDVNDNAPAFTQISYTLFVRENNSPALHIGSVSATDRDSGTNAQVTYSLLPPQDPHLPLSSLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFS

SEQ ID NO: 29179 - protein, 361 aa, Homo sapiens
MGGAVSAGEDNEELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 29180 - protein, 369 aa, Homo sapiens
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 29181 - protein, 241 aa, Homo sapiens
MQDPNEDTEWNDILRDFGILPPKEESKDEIEEMVLRLQKEAMVKPFEKMTLAQLKEAEDEFDEEDMQAVETYRKKRLQEWKALKKKQKFGELREISGNQYVNEVTNAEEDVWVIIHLYRSSIPMCLLVNQHLSLLARKFPETKFVKAIVNSCIQHYHDNCLPTIFVYKNGQIEAKFIGIIECGGINLKLEELEWKLAEVGAIQTDLEENPRKDMVDMMVSSIRNTSIHDDSDSSNSDNDTK

SEQ ID NO: 29182 - protein, 1112 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 29183 - protein, 415 aa, Homo sapiens
MASRWWRWRRGCSWKPAARSPGPGSPGRAGPLGPSAAAEVRAQVHRRKGLDLSQIPYINLVKHLTSACPNVCRISRFHHTTPDSKTHSGEKYTDPFKLGWRDLKGLYEDIRKELLISTSELKEMSEYYFDGKGKAFRPIIVALMARACNIHHNNSRHVQASQRAIALIAEMIHTASLVHDDVIDDASSRRGKHTVNKIWGEKKAVLAGDLILSAASIALARIGNTTVISILTQVIEDLVRGEFLQLGSKENENERFAHYLEKTFKKTASLIANSCKAVSVLGCPDPVVHEIAYQYGKNVGIAFQLIDDVLDFTSCSDQMGKPTSADLKLGLATGPVLFACQQFPEMNAMIMRRFSLPGDVDRARQYVLQSDGVQQTTYLAQQYCHEAIREISKLRPSPERDALIQLSEIVLTRDK

SEQ ID NO: 29184 - protein, 626 aa, Homo sapiens
MYQGHMQKSKEQGYGKLSSDEDLEIIVDQKQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 29185 - protein, 417 aa, Homo sapiens
MSLSKKLTLDKLDVRGKRVIMRVDFNVPMKKNQITNNQRIKASIPSIKYCLDNGAKAVVLMSHLGRPDGVPMPDKYSLAPVAVELKSLLGKDVLFLKDCVGAEVEKACANPAPGSVILLENLRFHVEEEGKGQDPSGKKIKAEPDKIEAFRASLSKLGDVYVNDAFGTAHRAHSSMVGVNLPHKASGFLMKKELDYFAKALENPVRPFLAILGGAKVADKIQLIKNMLDKVNEMIIGGGMAYTFLKVLNNMEIGASLFDEEGAKIVKDIMAKAQKNGVRITFPVDFVTGDKFDENAQVGKATVASGISPGWMGLDCGPESNKNHAQVVAQARLIVWNGPLGVFEWDAFAKGTKALMDEIVKATSKGCITVIGGGDTATCCAKWNTEDKVSHVSTGGGASLELLEGKILPGVEALSNM

SEQ ID NO: 29186 - protein, 323 aa, Homo sapiens
MTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 29187 - protein, 858 aa, Homo sapiens
MENELPVPHTSSSACATSSTSGASSSSGCNNSSSGGSGRPTGPQISVYSGIPDRQTVQVIQQALHRQPSTAAQYLQQMYAAQQQHLMLQTAALQQQHLSSAQLQSLAAVQQASLVSNRQGSTSGSNVSAQAPAQSSSINLAASPAAAQLLNRAQSVNSAAASGIAQQAVLLGNTSSPALTASQAQMYLRAQMLIFTPTATVATVQPELGTGSPARPPTPAQVQNLTLRTQQTPAAAASGPTPTQPVLPSLALKPTPGGSQPLPTPAQSRNTAQASPAGAKPGIADSVMEPHKKGDGNSSVPGSMEGRAGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 29188 - protein, 297 aa, Homo sapiens
MYAQPVTNTKEVKWQKVLYERQPFPDNYVDRRFLEELRKNIHARKYQYWAVVFESSVVIQQLCSVCVFVVIWWYMDEGLLAPHWLLGTGLASSLIGYVLFDLIDGGEGRKKSGQTRWADLKSALVFITFTYGFSPVLKTLTESVSTDTIYAMSVFMLLGHLIFFDYGANAAIVSSTLSLNMAIFASVCLASRLPRSLHAFIMVTFAIQIFALWPMLQKKLKACTPRSYVGVTLLFAFSAVGGLLSISAVGAVLFALLLMSISCLCPFYLIRLQLFKENIHGPWDEAEIKEDLSRFLS

SEQ ID NO: 29189 - protein, 297 aa, Homo sapiens; identical to SEQ ID NO: 29188

SEQ ID NO: 29190 - protein, 461 aa, Homo sapiens
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERIMMNYDKLKSRLGEIHDSKMRLEQDLKNQALDNREIDKKMNSIKPDLIQLRKIRDQHLVWLNHKGVRQKRLNVWLGIKNEDAAENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 29191 - protein, 549 aa, Homo sapiens
MSSAAENGEAAPGKQNEEKTYKKTQVKNQILSRLPKIPCTFIQAWTNTEMITLLACYYFRSVSTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFTGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNRFKMATSEH

SEQ ID NO: 29192 - protein, 540 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNSKGLPSSSTFTLEEGTIYLTAEPNTLEVQDDNASVLDVYL

SEQ ID NO: 29193 - protein, 861 aa, Homo sapiens
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPKRLQQKVTEVFSKTRNGEDVRITITLTNELPPTSPTCLQFYNIIFRRLLKIMNLQQIGRNYYNPNDPIDIPSHRLVIWPGFTTSILQYENSIMLCTDVSHKVLRSETVLDFMFNFYHQTEEHKFQEQVSKELIGLVVLTKYNNKTYRVDDIDWDQNPKSTFKKADGSEVSFLEYYRKQYNQEITDLKQPVLVSQPKRRRGPGGTLPGPAMLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFIVSQAVRSGSVSPTHYNVIYDNSGLKPDHIQRLTYKLCHIYYNWPGVIRVPAPCQYAHKLAFLVGQSIHREPNLSLSNRLYYL

SEQ ID NO: 29194 - protein, 609 aa, Homo sapiens
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRPDFELGKMIKQSYKNVLEKFRLKKAQKDEDKKTKGSGDLAEQARREGFDENEIQNAEQMKKWKERLEKKYYSMEIQDDYQPVTQEEFRDGTTTKYKMRFSLSA

SEQ ID NO: 29195 - protein, 608 aa, Homo sapiens
MEMRWFLSKIQDDFRGGKINLEKTQRLLEKLDIRCSYIHVKQIFKDNDRLKQGRITIEEFRAIYRIITHREEIIEIFNTYSENRKILLASNLAQFLTQEQYAAEMSKAIAFEIIQKYEPIEEVRKAHQMSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 29196 - protein, 933 aa, Homo sapiens
MTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNCLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEVQVGKRSTEARHGVRIDTSHRSLILKCSSYRQARWWAQEITELAQGPGRDFLQLHRHDSYAPPRPGTLARWFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPIYPYLLPKSTSTANQLPFTLPGGQCTTVQVLRSVDRWSAGTLENSILNAYLHTIRESQHFLYIENQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGRFALSLRKHCFGVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 29197 - protein, 329 aa, Homo sapiens
MSGVVPTAPEQPAGEMENQTKPPDPRPDAPPEYSSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYVVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 29198 - protein, 870 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 29199 - protein, 747 aa, Homo sapiens
MWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIKNALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMRMSQGVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRNSFSALVVAWYSSACHVSNTLRPLTYGDKSLSPHELKALRWKDSWDILIRKH

SEQ ID NO: 29200 - protein, 653 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQIIDILWSDPRGKNGCFPNTCRGGGCYFGPDVTSKILNKYQLKMLIRSHECKPEGYEICHDGKVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 29201 - protein, 501 aa, Homo sapiens
MPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQIIDILWSDPRGKNGCFPNTCRGGGCYFGPDVTSKILNKYQLKMLIRSHECKPEGYEICHDGKVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 29202 - protein, 625 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKIIDILWSDPRGKNGCFPNTCRGGGCYFGPDVTSKILNKYQLKMLIRSHECKPEGYEICHDGKVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 29203 - protein, 376 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQSGYYGKQRHQDIKRESDFTKK

SEQ ID NO: 29204 - protein, 591 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 29205 - protein, 414 aa, Homo sapiens
MKLHCEVEVISRHLPALGLRNRGKGVRAVLSLCQQTSRSQPPVRAFLLISTLKDKRGTRYELRENIEQFFTKFVDEGKATVRLKEPPVDICLSKAISSSLKGFLSAMRLAHRGCNVDTPVSTLTPVKTSEFENFKTKMVITSKKDYPLSKNFPYSLEHLQTSYCGLVRVDMRMLCLKSLRKLDLSHNHIKKLPATIGDLIHLQELNLNDNHLESFSVALCHSTLQKSLRSLDLSKNKIKALPVQFCQLQELKNLKLDDNELIQFPCKIGQLINLRFLSAARNKLPFLPSEFRNLSLEYLDLFGNTFEQPKVLPVIKLQAPLTLLESSARTILHNRIPYGSHIIPFHLCQDLDTAKICVCGRFCLNSFIQGTTTMNLHSVAHTVVLVDNLGGTEAPIISYFCSLGCYVNSSDMLK

SEQ ID NO: 29206 - protein, 127 aa, Homo sapiens
MVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 29207 - protein, 351 aa, Homo sapiens
MAAAANSGSSLPLFDCPTWAGKPPPGLHLDVVKGDKLIEKLIIDEKKYYLFGRNPDLCDFTIDHQSCSRVHAALVYHKHLKRVFLIDLNSTHGTFLGHIRLEPHKPQQIPIDSTVSFGASTRAYTLREKPQTLPSAVKGDEKMGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 29208 - protein, 209 aa, Homo sapiens
MGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 29209 - protein, 173 aa, Homo sapiens
MSTMGNEASYPAEMCSHFDNDEIKRLGRRFKKLDLDKSGSLSVEEFMSLPELRHNPLVRRVIDVFDTDGDGEVDFKEFILGTSQFSVKGDEEQKLRFAFSIYDMDKDGYISNGELFQVLKMMVGNNLTDWQLQQLVDKTIIILDKDGDGKISFEEFSAVVRDLEIHKKLVLIV

SEQ ID NO: 29210 - protein, 933 aa, Homo sapiens
MADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 29211 - protein, 509 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 29212 - protein, 509 aa, Homo sapiens; identical to SEQ ID NO: 29211

SEQ ID NO: 29213 - protein, 509 aa, Homo sapiens; identical to SEQ ID NO: 29211

SEQ ID NO: 29214 - protein, 509 aa, Homo sapiens; identical to SEQ ID NO: 29211

SEQ ID NO: 29215 - protein, 509 aa, Homo sapiens; identical to SEQ ID NO: 29211

SEQ ID NO: 29216 - protein, 479 aa, Homo sapiens
MSLQAPRRLLELAGQSLLGDQALAISILDELPRELFPPLFVEAFTSRRCEVLKVMVQAWPFPCLPLGSLMKTPDLEILHYVVDGIDCLLAQKVRPRRRKLQVLELRDVDENFWTIWSGARPLSCSPEAMSKRQTVEDCPRTGEKQPLKVFMDVCLKEKFMDEDLSFFSGWVQHRRGSVHLCCTKVVNYSMSILNFRNILETVYPDSIQVLEIWNMCWPCMIVEFIRYLSQMRNLRKLFISDGCRYLLSSDSQEQLVAEFSSVLLRLEYLQMLYVRRVCFFRGHLDQLIRCLRSPLETLALTYGFLEKVDLKCLPRYPSLSQLKQLNLSHGALRFIRLEPLRALLEKVAATLQTLFLVDCGIRDSKLRVILPALSCCSNLTTFCFHGNDTSMDGLKDLLRHTGRLSNLSLETYPAPRESLDDRGRVISELLTPLQAELMRILREVREPKRIFFGPVSCPCCGTSPTEQLEFNFCLWGRPA

SEQ ID NO: 29217 - protein, 404 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 29218 - protein, 51 aa, Homo sapiens
MARYRCCRSQSRSRYYRQRQRSRRRRRRSCQTRRRAMRCCRPRYRPRCRRH

SEQ ID NO: 29219 - protein, 102 aa, Homo sapiens
MVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 29220 - protein, 176 aa, Homo sapiens
MRKHLSWWWLATVCMLLFSHLSAVQTRGIKHRIKWNRKALPSTAQITEAQVAENRPGAFIKQGRKLDIDFGAEGNRYYEANYWQFPDGIHYNGCSEANVTKEAFVTGCINATQAANQGEFQKPDNKLHQQVLWRLVQELCSLKHCEFWLERGAGLRVTMHQPVLLCLLALIWLTVK

SEQ ID NO: 29221 - protein, 196 aa, Homo sapiens
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEGTAFILHMNFLMFFLCINFRKHHRDGEKYLLTLIHRFLIN

SEQ ID NO: 29222 - protein, 441 aa, Homo sapiens
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEVSQKLSEIQALTLTKEKVPLERNAGSPVYMKGVTKSGIPISWYRDLHDVPKGYSFYLAHEFFDVLPVHKFQKTPQGWREVFVDIDPQVSDKLRFVLAPSATPAEAFIQHDETRDHVEVCPDAGVIIEELSQRIALTGGAALVADYGHDGTKTDTFRGFCDHKLHDVLIAPGTADLTADVDFSYLRRMAQGKVASLGPIKQHTFLKNMGIDVRLKVLLDKSNEPSVRQQLLQGYDMLMNPKKMGERFNFFALLPHQRLQGGRYQRNARQSKPFASVVAGFSELAWQ

SEQ ID NO: 29223 - protein, 336 aa, Homo sapiens
MWVRTTLTIERWTKEKTEPKARSWDESRCRGDCKEPDKCCWRHKQCTGHIIYPFASDCVRHSLHLHSVNHCNCNSRLKDSSEDSSSSRGAGPTCSHVIESPCFELTPEEEHVERFRYGWCKSYRPVSVAVIHHPLYHECGADDLNEEEEEEEEESKPPIPTQVGPATASPDLGTSMATGTPDSTAPITIWRSESPTGKGQGSKVIKKVKKKKEKEKDKEEMDEKAKLKKKAKKGQLTKKKSPVKLEPSPPDVSRSLSARQLARMSESSPESREELESEDSYNGRGQGELSSEDIVESSSPRKRENTVQAKKTGAKPSQARKVNKRKSPPGSNPNLS

SEQ ID NO: 29224 - protein, 105 aa, Homo sapiens
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 29225 - protein, 250 aa, Homo sapiens
MASRYDRAITVFSPDGHLFQVEYAQEAVKKGSTAVGIRGTNIVVLGVEKKSVAKLQDERTVRKICALDDHVCMAFAGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 29226 - protein, 212 aa, Homo sapiens
MASRYDRAITVFSPDGHLFQVEYAQEAVKKGSTAVGIRGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 29227 - protein, 256 aa, Homo sapiens
MASRYDRAITVFSPDGHLFQVEYAQEAVKKGSTAVGIRGTNIVVLGVEKKSVAKLQDERTVRKICALDDHVCMAFAVLTIFIGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 29228 - protein, 152 aa, Homo sapiens
MTCTDQKSHSQRALGTQTPALQGPQLLNTDPSSKETRPPHVNPDRLCHMEPANHFWHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 29229 - protein, 807 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 29230 - protein, 202 aa, Homo sapiens
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 29231 - protein, 215 aa, Homo sapiens
MASRGATRPNGPNTGNKICQFKLVLLGESAVGKSSLVLRFVKGQFHEFQESTIGAAFLTQTVCLDDTTVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKLPKNEPQNPGANSARGRGVDLTEPTQPTRNQCCSN

SEQ ID NO: 29232 - protein, 419 aa, Homo sapiens
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 29233 - protein, 1105 aa, Homo sapiens
MAATASAGVPATVSEKQEFYQLLKNLINPSCMVRRQAEEIYENIPGLCKTTFLLDAVRNRRAGYEVRQMAAALLRRLLSSGFEEVYPNLPADVQRDVKIELILAVKLETHASMRKKLCDIFAVLARNLIDEDGTNHWPEGLKFLIDSIYSKNVVLWEVALHVFWHFPGIFGTQERHDLDIIKRLLDQCIQDQEHPAIRTLSARAAAAFVLANENNIALFKDFADLLPGILQAVNDSCYQDDDSVLESLVEIADTVPKYLGPYLEDTLQLSLKLCGDSRLSNLQRQLALEVIVTLSETATPMLKKHTNIIAQAVPHILAMMVDLQDDEDWVNADEMEEDDFDSNAVAAESALDRLACGLGGKVVLPMTKEHIMQMLQSPDWKYRHAGLMALSAIGEGCHQQMESILDETVNSVLLFLQDPHPRVRAAACTTLGQMATDFAPNFQKKFHETVIAALLRTMENQGNQRVQSHAASALIIFIEDCPKSLLVLYVDSMVKNLHSVLVIKLQELIRNGTKLALEQLVTTIASVADTIEEKFVPYYDIFMPSLKHIVELAVQKELKLLRGKTIECISHIGLAVGKEKFMQDASNVMQLLLKTQSDLNNMEDDDPQTSYMVSAWARMCKILGKDFQQYLPLVIEPLIKTASAKPDVALLDTQDVENMSDDDGWQFVNLGDQQSFGIKTSGLEAKATACQMLVYYAKELREGFVEYTEQVVKLMVPLLKFYFHDNVRVAAAESMPFLLECARIRGPEYLAQMWQFICDPLIKAIGTEPDTDVLSEIMNSFAKSIEVMGDGCLNDEHLEELGGILKAKLEGHFKNQELRQVKRQEENYDQQVEMSLQDEDECDVYILTKVSDILHSLFSTYKEKILPWFEQLLPLIVNLICSSRPWPDRQWGLCIFDDIIEHCSPTSFKYVEYFRWPMLLNMRDNNPEVRQAAAYGLGVMAQFGGDDYRSLCSEAVPLLVKVIKCANSKTKKNVIATENCISAIGKILKFKPNCVNVDEVLPHWLSWLPLHEDKEEAIQTLSFLCDLIESNHPVVIGPNNSNLPKIISIIAEGKINETINYEDPCAKRLANVVRQVQTSEDLWLECVSQLDDEQQEALQELLNFA

SEQ ID NO: 29234 - protein, 376 aa, Homo sapiens
MAEERPGAWFGFGFCGFGQELGSGRGRQVHSPSPLRAGVDICRVSASWSYTAFVTRGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREATELNEDGSQVKRTGGAEDGAPAPFIAVQPFPALLDLPMGSDAVKASCGSRHTAVVTRTGELYTWGWGKYGQLGHEDTTSLDRPRRVEYFVDKQLQVKAVTCGPWNTYVYAVEKGKS

SEQ ID NO: 29235 - protein, 376 aa, Homo sapiens; identical to SEQ ID NO: 29234

SEQ ID NO: 29236 - protein, 1221 aa, Homo sapiens
MLRSTGFFRAIDCPYWSGAPGGPCRRPYCHFRHRGARGPGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQPSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 29237 - protein, 723 aa, Homo sapiens
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLEMAIENLQKSEGITSHKSGLLNSHLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 29238 - protein, 698 aa, Homo sapiens
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 29239 - protein, 1376 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 29240 - protein, 500 aa, Homo sapiens
MSFEELCYKNPKMAIQKISDDYKIYCEKAPKIDFKMEIIKETKTVSRSNRKMSLLKRTLVRKPSMRPRNLTEVLLNTQHLEFFREFLKERKAKIPLQFLTAVQKISIETNEKICKSLIENVIKTFFQGQLSPEEMLQCDAPIIKEIASMRHVTTSTLLTLQGHVMKSIEEKWFKDYQDLFPPHHQEVEVQSEVQISSRKPSKIVSTYLQESQKKGWMRMISFIRSFCKYRRFMLNPSKRQEFEDYLHQEMQNSKENFTTAHNTSGRSAPPSTNVRSADQENGEITLVKRRIFGHRIITVNFAINDLYFFSEMEKFNDLVSSAHMLQVNRAYNENDVILMRSKMNIIQKLFLNSDIPPKLRVNVPEFQKDAILAAITEGYLDRSVFHGAIMSVFPVVMYFWKRFCFWKATRSYLQYRGKKFKDRKSPPKSTDKYPFSSGGDNAILRFTLLRGIEWLQPQREAISSVQNSSSSKLTQPRLVVSAMQLHPVQGQKLSYIKKEK

SEQ ID NO: 29241 - protein, 519 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 29242 - protein, 424 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVRSTFC

SEQ ID NO: 29243 - protein, 464 aa, Homo sapiens
MMAAMLSHAYGPGGCGAAAAALNGEQAALLRRKSVNTTECVPVPSSEHVAEIVGRQGCKIKALRAKTNTYIKTPVRGEEPIFVVTGRKEDVAMAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAQTIWTPFEPVNPLSGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 29244 - protein, 569 aa, Homo sapiens
MPSSLFADLERNGSGGGGGGSSGGGETLDDQRALQLALDQLSLLGLDSDEGASLYDSEPRKKSVNMTECVPVPSSEHVAEIVGRQGCKIKALRAKTNTYIKTPVRGEEPVFVVTGRKEDVAMARREIISAAEHFSMIRASRNKNTALNGAVPGPPNLPGQTTIQVRVPYRVVGLVVGPKGATIKRIQQQTHTYIVTPSRDKEPVFEVTGMPENVDRAREEIEAHIALRTGGIIELTDENDFHANGTDVGFDLHHGSGGSGPGSLWSKPTPSITPTPGRKPFSSYRNDSSSSLGSASTDSYFGGGTSSSAAATQRLADYSPPSPALSFAHNGNNNNNGNGYTYTAGGEASVPSPDGCPELQPTFDPAPAPPPGAPLIWAQFERSPGGGPAAPVSSSCSSSASSSASSSSVVFPGGGASAPSNANLGLLVHRRLHPGTSCPRLSPPLHMAPGAGEHHLARRVRSDPGGGGLAYAAYANGLGAQLPGLQPSDTSGSSSSSSSSSSSSSSSSGLRRKGSRDCSVCFESEVIAALVPCGHNLFCMECANRICEKSEPECPVCHTAVTQAIRIFS

SEQ ID NO: 29245 - protein, 199 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 29246 - protein, 305 aa, Homo sapiens
MSFLRITPSTHSSVSSGLLRLSIFLLLSFPDSNGKAIWTAHLNITFQVGNEITSELGESGVFGNHSPLERVSGVVALPEGWNQNACHPLTNFSRPKQADSWLALIERGGCTFTHKINVAAEKGANGVIIYNYQGTGSKVFPMSHQGTENIVAVMISNLKGMEILHSIQKGVYVTVIIEVGRMHMQWVSHYIMYLFTFLAATIAYFYLDCVWRLTPRVPNSFTRRRSQIKTDVKKAIDQLQLRVLKEGDEELDLNEDNCVVCFDTYKPQDVVRILTCKHFFHKACIDPWLLAHRTCPMCKCDILKT

SEQ ID NO: 29247 - protein, 350 aa, Homo sapiens [sequence omitted]

SEQ ID NO: 29248 - protein, 571 aa, Homo sapiens
MALPKDAIPSLSECQCGICMEILVEPVTLPCNHTLCKPCFQSTVEKASLCCPFCRRRVSSWTRYHTRRNSLVNVELWTIIQKHYPRECKLRASGQESEEVADDYQPVRLLSKPGELRREYEEEISKVAAERRASEEEENKASEEYIQRLLAEEEEEEKRQAEKRRRAMEEQLKSDEELARKLSIDINNFCEGSISASPLNSRKSDPVTPKSEKKSKNKQRNTGDIQKYLTPKSQFGSASHSEAVQEVRKDSVSKDIDSSDRKSPTGQDTEIEDMPTLSPQISLGVGEQGADSSIESPMPWLCACGAEWYHEGNVKTRPSNHGKELCVLSHERPKTRVPYSKETAVMPCGRTESGCAPTSGVTQTNGNNTGETENEESCLLISKEISKRKNQESSFEAVKDPCFSAKRRKVSPESSPDQEETEINFTQKLIDLEHLLFERHKQEEQDRLLALQLQKEVDKEQMVPNRQKGSPDEYHLRATSSPPDKVLNGQRKNPKDGNFKRQTHTKHPTPERGSRDKNRQVSLKMQLKQSVNRRKMPNSTRDHCKVSKSAHSLQPSISQKSVFQMFQRCTK

SEQ ID NO: 29249 - protein, 258 aa, Homo sapiens
MAKYQGEVHSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 29250 - protein, 362 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLRKKFFEKKFTEISHRILCSYNTNIEELFAEIDQCLAINRSVLQQLEEKCGHEITEEEWEKIQVQALRRETHECSICLAPLSAAGGQRVGAGRRSREMALLSCSHVFHHACLLALEEFSVGDRPPFHACPLCRSCYQKKILEC

SEQ ID NO: 29251 - protein, 515 aa, Homo sapiens
MACKISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 29252 - protein, 432 aa, Homo sapiens
MRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 29253 - protein, 465 aa, Homo sapiens
MACKSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 29254 - protein, 432 aa, Homo sapiens; identical to SEQ ID NO: 29252

SEQ ID NO: 29255 - protein, 414 aa, Homo sapiens
MRPWEMTSNRQPPSVRPSQHHFSGERCNTPARNRRSPPVRRQRGRRDRLSRHNSISQDAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 29256 - protein, 432 aa, Homo sapiens; identical to SEQ ID NO: 29252

SEQ ID NO: 29257 - protein, 552 aa, Homo sapiens
MDGVVTDLITVGLKRGSDELLSSGIINGPFTMNSSTPSTANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 29258 - protein, 212 aa, Homo sapiens
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEEIEWLKFLALACSALGVTITKTLKIVCEVLSCDHNGGSPRIPFSTFQFLYTYIAKVDGEISASHVSRMLNYMEQEVIGPDGIITVNDFTQNPRVQLE

SEQ ID NO: 29259 - protein, 230 aa, Homo sapiens
MPLPDTMFCAQQIHIPPELPDILKQFTKAAIRTQPADVLRWSAGYFSALSRGDPLPVKDRMEMPTATQKTDTGLTQGLLKVLHKQCHHKRYVELTDLEQKWKNLCLPKEKFKALLQLDPCENKIKWINFLALGCSMLGGSLNTALKHLCEILTDDPEGGPARIPFKTFSYVYRYLARLDSDVSPLETESYLASLKENIDARKNGMIGLSDFFFPKRKLLESIENSEDVGH

SEQ ID NO: 29260 - protein, 361 aa, Homo sapiens
MNLVICVLLLSIWKNNCMTTNQTNGSSTTGDKPVESMQTKLNYLRRNLLILVGIIIMVFVFICFCYLHYNCLSDDASKAGMVKKKGIAAKSSKTSFSEAKTASQCSPETQPMLSTADKSSDSSSPERASAQSSTEKLIRPSSLQKPSIPNSAGKLTRPSYPKRSSKSSCSKKLSKSSHLEKAHKKGSLEKLCKLDYACKLASSDKPVRPPQLFKPLYSSHPQNEISPSKPFGPQELAKPPKHFNPKRSVSLGRAALLSNSELAETCQPYKKKHLVAKTYRPLVNDISEAKEKNTQNLHVSSKVKSSSRSFRKLDSRNNAYGDHVNDSDTMKYYSEVDSDKVIIITCDRGYNQVTSEVTLND

SEQ ID NO: 29261 - protein, 159 aa, Homo sapiens
MKAWGTVVVTLATLMVVTVDAKIYELCELAARLERAGLNGYKGYGVGDWLCMAHYESGFDTAFVDHNPDGSSEYGIFQLNSAWWCDNGITPTKNLCHMDCHDLLNRHILDDIRCAKQIVSSQNGLSAWTSWRLHCSGHDLSEWLKGCDMHVKIDPKIHP

SEQ ID NO: 29262 - protein, 189 aa, Homo sapiens; identical to SEQ ID NO: 28626

SEQ ID NO: 29263 - protein, 189 aa, Homo sapiens
MTDKTEKVAVDPETVFKRPRECDSPSYQKRQRMALLARKQGAGDSLIAGSAMSKEKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 29264 - protein, 189 aa, Homo sapiens
MTDKTEKVAVDPETVFKRPRECDSPSYQKRQRMALLARKQGAGDSLIAGSAMSKEKKLMTGHAIPPSQLDSQIDDFTGFSKDGMMQKPGSNAPVGGNVTSNFSGDDLECRGIASSPKSQQEINADIKCQVVKEIRCLGRKYEKIFEMLEGVQGPTAVRKRFFESIIKEAARCMRRDFVKHLKKKLKRMI

SEQ ID NO: 29265 - protein, 153 aa, Homo sapiens
MAAALALVAGVLSGAVLPLWSALPQYKKKITDRCFHHSECYSGCCLMDLDSGGAFCAPRARITMICLPQWLELFKGRDCIIFIYEAPTPSLVSAHNQGSYQHHLPLPDGLDVHIQGLDVFPPVPYDLEEDAGWSLLPWGHRPWLPPTCSKSSS

SEQ ID NO: 29266 - protein, 463 aa, Homo sapiens
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALNPKVNLFAELTPEEIDELGYTLYCSLSEPEVLLQT

SEQ ID NO: 29267 - protein, 171 aa, Homo sapiens
MWTLKSSLVLLLCLTCSYAFMFSSLRQKTSEPQGKVPCGEHFRIRQNLPEHTQGWLGSKWLWLLFAVVPFVILQCQRDSEKNKEQSPPGLRGFPFRTPLKKNQNASLYKDCVFNTLNELEVELLKFVSEVQNLKGAMATGSGSNLKLRRSEMPADPYHVTICKIWGEESSS

SEQ ID NO: 29268 - protein, 1286 aa, Homo sapiens
MSHLVDPTSGDLPVRDIDAIPLVLPASKGKNMKTQPPLSRMNREELEDSFFRLREDHMLVKELSWKQQDEIKRLRTTLLRLTAAGRDLRVAEEAAPLSETARRGQKAGWRQRLSMHQRPQMHRLQGHFHCVGPASPRRAQPRVQVGHRQLHTAGAPVPEKPKRGPRDRLSYTAPPSFKEHATNENRGEVASKPSELVSGSNSIISFSSVISMAKPIGLCMPNSAHIMASNTMQVEEPPKSPEKMWPKDENFEQRSSLECAQKAAELRASIKEKVELIRLKKLLHERNASLVMTKAQLTEVQEAYETLLQKNQGILSAAHEALLKQVNELRAELKEESKKAVSLKSQLEDVSILQMTLKEFQERVEDLEKERKLLNDNYDKLLESMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEGILRSHDLPTSEQLKDVAYGTRPLSLCLETLPAHGDEDKVDISLLHQGENLFELHIHQAFLTSAALAQAGDTQPTTFCTYSFYDFETHCTPLSVGPQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPQQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 29269 - protein, 690 aa, Homo sapiens
MTDTVFSNSSNRWMYPSDRPLQSKLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 29270 - protein, 51 aa, Homo sapiens
MSSHKTFTIKRFLAKKQKQNRPIPQWIQMKPGSKIRYNSKRRHWRRTKLGL

SEQ ID NO: 29271 - protein, 740 aa, Homo sapiens
MPLAQLADPWQKMAVESPSDSAENGQQIMDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 29272 - protein, 1687 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTDSQSDAETAAAAGEVLDLTSRDREQPSEGATELRQVAGDAPVEQATAETASPVHREEHGRGESHEPEEEHGTEESTGDADGAEEDASSNQSLDLDFATKLMDFKLAEGDGEAGAGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 29273 - protein, 1742 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTGQKPFPCQKCDAFFSTKSNCERHQLRKHGVTTCSLRRNGLIPQSKESDVGSHDSTDSQSDAETAAAAGEVLDLTSRDREQPSEGATELRQVAGDAPVEQATAETASPVHREEHGRGESHEPEEEHGTEESTGDADGAEEDASSNQSLDLDFATKLMDFKLAEGDGEAGAGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 29274 - protein, 1687 aa, Homo sapiens; identical to SEQ ID NO: 29272

SEQ ID NO: 29275 - protein, 359 aa, Homo sapiens
MPNPSSTSSPYPLPEEIRNLLADVETFVADILKGENLSKKAKEKRESLIKKIKDVKSIYLQEFQDKGDAEDGEEYDDPFAGPPDTISLASERYDKDDEAPSDGAQFPPIAAQDLPFVLKAGYLEKRRKDHSFLGFEWQKRWCALSKTVFYYYGSDKDKQQKGEFAIDGYSVRMNNTLRKDGKKDCCFEISAPDKRIYQFTAASPKDAEEWVQQLKFVLQDMESDIIPEDYDERGELYDDVDHPLPISNPLTSSQPIDDEIYEELPEEEEDSAPVKVEEQRKMSQDSVHHTSGDKSTDYANFYQGLWDCTGAFSDELSFKRGDVIYILSKEYNRYGWWVGEMKGAIGLVPKAYIMEMYDI

SEQ ID NO: 29276 - protein, 301 aa, Homo sapiens
MAMLVLVPGRVMRPLGGQLWRFLPRGLEFWGPAEGTARVLLRQFCARQAEAWRASGRPGYCLGTRPLSTARPPPPWSQKGPGDSTRPSKPGPVSWKSLAITFAIGGALLAGMKHVKKEKAEKLEKERQRHIGKPLLGGPFSLTTHTGERKTDKDYLGQWLLIYFGFTHCPDVCPEELEKMIQVVDEIDSITTLPDLTPLFISIDPERDTKEAIANYVKEFSPKLVGLTGTREEVDQVARAYRVYYSPGPKDEDEDYIVDHTIIMYLIGPDGEFLDYFGQNKRKGEIAASIATHMRPYRKKS

SEQ ID NO: 29277 - protein, 221 aa, Homo sapiens
MPLALTLLLLSGLGAPGGWGCLQCDPLVLEALGHLRSALIPSRFQLEQLQARAGAVLMGMEGPFFRDYALNVFVGKVETNQLDLVASFVKNQTQHLMGNSLKDEPLLEELVTLRANVIKEFKKVLISYELKACNPKLCRLLKEEVLDCLHCQRITPKCIHKKYCFVDRQPRVALQYQMDSKYPRNQALLGILISVSLAVFVFVVIVVSACTYRQNRKLLLQ

SEQ ID NO: 29278 - protein, 473 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 29279 - protein, 473 aa, Homo sapiens; identical to SEQ ID NO: 29278

SEQ ID NO: 29280 - protein, 1265 aa, Homo sapiens
MECPVMETDSLFTSGIKRHLKDKRISKTTKLNVSLASKIKTKILNNSSIFKISLKHNNRALAQALSREKENSRRITTEKMLLQKEVEKLNFENTFLRLKLNNLNKKLIDIEALMNNNLITAIEMSSLSEFHQSSFLLSASKKKRISKQCKLMRLPFARVPLTSNDDEDEDKEKMQCDNNIKSKTLPDIPSSGSTTQPLSTQDNSEVLFLKENNQNVYGLDDSEHISSIVDVPPRESHSHSDQSSKTSLMSEMRNAQSIGRRWEKPSPSNVTERKKRGSSWESNNLSADTPCATVLDKQHISSPELNCNNEINGHTNETNTEMQRNKQDLPGLSSESAREPNAECMNQIEDNDDFQLQKTVYDADMDLTASEVSKIVTVSTGIKKKSNKKTNEHGMKTFRKVKDSSSEKKRERSKRQFKNSSDVDIGEKIENRTERSDVLDGKRGAEDPGFIFNNEQLAQMNEQLAQVNELKKMTLQTGFEQGDRENVLCNKKEKRITNEQEETYSLSQSSGKFHQESKFDKGQNSLTCNKSKASRQTFVIHKLEKDNLLPNQKDKVTIYENLDVTNEFHTANLSTKDNGNLCDYGTHNILDLKKYVTDIQPSEQNESNINKLRKKVNRKTEIISGMNHMYEDNDKDVVHGLKKGNFFFKTQEDKEPISENIEVSKELQIPALSTRDNENQCDYRTQNVLGLQKQITNMYPVQQNESKVNKKLRQKVNRKTEIISEVNHLDNDKSIEYTVKSHSLFLTQKDKEIIPGNLEDPSEFETPALSTKDSGNLYDSEIQNVLGVKHGHDMQPACQNDSKIGKKPRLNVCQKSEIIPETNQIYENDNKGVHDLEKDNFFSLTPKDKETISENLQVTNEFQTVDLLIKDNGNLCDYDTQNILELKKYVTDRKSAEQNESKINKLRNKVNWKTEIISEMNQIYEDNDKDAHVQESYTKDLDFKVNKSKQKLECQDIINKHYMEVNSNEKESCDQILDSYKVVKKRKKESSCKAKNILTKAKNKLASQLTESSQTSISLESDLKHITSEADSDPGNPVELCKTQKQSTTTLNKKDLPFVEEIKEGECQVKKVNKMTSKSKKRKTSIDPSPESHEVMERILDSVQGKSTVSEQADKENNLENEKMVKNKPDFYTKAFRSLSEIHSPNIQDSSFDSVREGLVPLSVSSGKNVIIKENFALECSPAFQVSDDEHEKMNKMKFKVNRRTQKSGIGDRPLQDLSNTSFVSNNTAESENKSEDLSSERTSRRRRCTPFYFKEPSLRDKMRR

SEQ ID NO: 29281 - protein, 810 aa, Homo sapiens
MASWRKPASPGTPGALRPSALCPPVRVPRSRSAAFAPPLALSPCVLVSLWCGAWAGSGGVSCRCQVGYTAALAHRPVSWDDSAPRPSAVAGAASPIPHLKGPKDGATAHEESEEEDAQRPSTHKGRARTTLSASSEPGSILHTGNGDTPVQCHLSSSKRRGMTGEQRSHKGSAENEARSAGRGQCQGPSRPLIGWCGRAERLRGRRLPPPSPAAEPSTLLGPGTLPGPLAVPRSAPSEVAQRDRQPTLERFAPPRPPLRGLGPPAPGTALPAPVSPVSRGREAAPPAHARTSPSPHPAVLFSSLYPPCRLHHPSWVPPEGGHLRPPAAGPDTQSASETFQEGPELRAPQEVVLGDPHPTAEDLEAESLSDLPKPPLPWSWKPGTLGAMQKAGAGGRRASDCGLAPHRPRCITKFAQYVGSFPVDDLDTQESVWLVQQQLWALKDCPRRRAVILKFSLQGLKIYSGEGEVLLMAHALRRILYSTWCPADCQFAFMARNPRSPASKLFCHLFVGSQPGEVQILHLLLCRSFQLAYLLQHPEERAQPEPCPGPTGEVPLKPLSSSGGLVREPFGRDQLSQNVHALVSFRRLPAEGLVGSGKELPESEGRARHARLGNPYCSPTLVRKKAIRSKVIRSGAYRGCTYETQLQLSAREAFPAAWEAWPRGPGGHSCLVESEGSLTENIWAFAGISRPCALALLRRDVLGAFLLWPELGASGQWCLSVRTQCGVVPHQVFRNHLGRYCLEHLPAEFPSLEALVENHAVTERSLFCPLDMGRLNPTYEEQDCGPPGRPPRTLRPLSHAKSEAELQGLG

SEQ ID NO: 29282 - protein, 776 aa, Homo sapiens
MEPTRVGKRKRDFPEIKQQECFRCQVGYTAALAHRPVSWDDSAPRPSAVAGAASPIPHLKGPKDGATAHEESEEEDAQRPSTHKGRARTTLSASSEPGSILHTGNGDTPVQCHLSSSKRRGMTGEQRSHKGSAENEARSAGRGQCQGPSRPLIGWCGRAERLRGRRLPPPSPAAEPSTLLGPGTLPGPLAVPRSAPSEVAQRDRQPTLERFAPPRPPLRGLGPPAPGTALPAPVSPVSRGREAAPPAHARTSPSPHPAVLFSSLYPPCRLHHPSWVPPEGGHLRPPAAGPDTQSASETFQEGPELRAPQEVVLGDPHPTAEDLEAESLSDLPKVTPANHPPLPWSWKPGTLGAMQKAGAGGRRASDCGLAPHRPRCITKFAQYVGSFPVDDLDTQESVWLVQQQLWALKDCPRRRAVILKFSLQGLKIYSGEGEVLLMAHALRRILYSTWCPADCQFAFMARNPRSPASKLFCHLFVGSQPGEVQILHLLLCRSFQLAYLLQHPEERAQPEPCPGPTGEVPLKPLSSSGGLVREPFGRDQLSQNVHALVSFRRLPAEGLVGSGKELPESEGRARHARLGNPYCSPTLVRKKAIRSKVIRSGAYRGCTYETQLQLSAREAFPAAWEAWPRGPGGHSCLVESEGSLTENIWAFAGISRPCALALLRRDVLGAFLLWPELGASGQWCLSVRTQCGVVPHQVFRNHLGRYCLEHLPAEFPSLEALVENHAVTERSLFCPLDMGRLNPTYEEQDCGPPGRPPRTLRPLSHAKSEAELQGLG

SEQ ID NO: 29283 - protein, 729 aa, Homo sapiens
MDDLTLLDLLECPVCFEKLDVTAKVLPCQHTFCKPCLQRVFKAHKELRCPECRTPVFSNIEALPANLLLVRLLDGVRSGQSSGRGGSFRRPGTMTLQDGRKSRTNPRRLQASPFRLVPNVRIHMDGVPRAKALCNYRGQNPGDLRFNKGDIILLRRQLDENWYQGEINGISGNFPASSVEVIKQLPQPPPLCRALYNFDLRGKDKSENQDCLTFLKDDIITVISRVDENWAEGKLGDKVGIFPILFVEPNLTARHLLEKNKGRQSSCTKNLSLVSSSSRGNTSTLRRGPGSRRKVPGQFSITTALNTLNRMVHSPSGRHMVEISTPVLISSSNPSVITQPMEKADVPSSCVGQVSTYHPAPVSPGHSTAVVSLPGSQQHLSANMFVALHSYSAHGPDELDLQKGEGVRVLGKCQDGWLRGVSLVTGRVGIFPNNYVIPIFRKTSSFPDSRSPGLYTTWTLSTSSVSSQGSISEGDPRQSRPFKSVFVPTAIVNPVRSTAGPGTLGQGSLRKGRSSMRKNGSLQRPLQSGIPTLVVGSLRRSPTMVLRPQQFQFYQPQGIPSSPSAVVVEMGSKPALTGEPALTCISRGSEARIHSAASSLIMEDKEIPIKSEPLPKPPASAPPSILVKPENSRNGIEKQVKTVRFQNYSPPPTKHYTSHPTSGKPEQPATLKASQPEAASLGPEMTVLFAHRSGCHSGQQTDLRRKSALAKATTLVSTASGTQTVFPSK

SEQ ID NO: 29284 - protein, 1162 aa, Homo sapiens
MAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKELDHWTLLQGSWTDDYCMSKFKNTCWIPGYSAGVLNDTWVSFPSWSEDSTFVSSKKTPYEEQLHRCEDERFELDVVLETNLATIRVLESVQKKLSRMAPEDQEKFRLDDSLGGTSEVIQRRAIYRIYGDKAPEIIESLKKNPVTAVPVVLKRLKAKEEEWREAQQGFNKIWREQYEKAYLKSLDHQAVNFKQNDTKALRSKSLLNEIESVYDEHQEQHSEGRSAPSSEPHLIFVYEDRQILEDAAALISYYVKRQPAIQKEDQGTIHQLLHQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 29285 - protein, 431 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 29286 - protein, 1116 aa, Homo sapiens
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVYISSVVLFGACIEGVVLRDKFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 29287 - protein, 577 aa, Homo sapiens
MGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 29288 - protein, 301 aa, Homo sapiens
MKSGPGIQAAIDLTAGAAGGTACVLTGQPFDTIKVKMQTFPDLYKGLTDCFLKTYAQVGLRGFYKGTGPALMAYVAENSVLFMCYGFCQQFVRKVAGMDKQAKLSDLQTAAAGSFASAFAALALCPTELVKCRLQTMYEMEMSGKIAKSHNTIWSVVKGILKKDGPLGFYHGLSSTLLQEVPGYFFFFGGYELSRSFFASGRSKDELGPVHLMLSGGVAGICLWLVVFPVDCIKSRIQVLSMYGKQAGFIGTLLSVVRNEGIVALYSGLKATMIRAIPANGALFVAYEYSRKMMMKQLEAY

SEQ ID NO: 29289 - protein, 315 aa, Homo sapiens
MHREPAKKKAEKRLFDASSFGKDLLAGGVAAAVSKTAVAPIERVKLLLQVQASSKQISPEARYKGMVDCLVRIPREQGFFSFWRGNLANVIRYFPTQALNFAFKDKYKQLFMSGVNKEKQFWRWFLANLASGGAAGATSLCVVYPLDFARTRLGVDIGKGPEERQFKGLGDCIMKIAKSDGIAGLYQGFGVSVQGIIVYRASYFGAYDTVKGLLPKPKKTPFLVSFFIAQVVTTCSGILSYPFDTVRRRMMMQSGEAKRQYKGTLDCFVKIYQHEGISSFFRGAFSNVLRGTGGALVLVLYDKIKEFFHIDIGGR

SEQ ID NO: 29290 - protein, 504 aa, Homo sapiens
MEAAATPAAAGAARREELDMDVMRPLINEQNFDGTSDEEHEQELLPVQKHYQLDDQEGISFVQTLMHLLKGNIGTGLLGLPLAIKNAGIVLGPISLVFIGIISVHCMHILVRCSHFLCLRFKKSTLGYSDTVSFAMEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVVRNMPDPHNLPIVAGWKKYPLFFGTAVFAFEGIGVVLPLENQMKESKRFPQALNIGMGIVTTLYVTLATLGYMCFHDEIKGSITLNLPQDVWLYQSVKILYSFGIFVTYSIQFYVPAEIIIPGITSKFHTKWKQICEFGIRSFLVSITCAGAILIPRLDIVISFVGAVSSSTLALILPPLVEILTFSKEHYNIWMVLKNISIAFTGVVGFLLGTYITVEEIIYPTPKVVAGTPQSPFLNLNSTCLTSGLK

SEQ ID NO: 29291 - protein, 569 aa, Homo sapiens
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 29292 - protein, 736 aa, Homo sapiens
MKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTSKEVLRPYPPWALLLMITLFAIVILPIPAYFVYCRIHRIPFRPKSGDGPMTASTSLPLSHQLTPSKEVQKEEILQVDETKYPSTCNVTS

SEQ ID NO: 29293 - protein, 635 aa, Homo sapiens
MAKKSAENGIYSVSGDEKKGPLIAPGPDGAPAKGDGPVGLGTPGGRLAVPPRETWTRQMDFIMSCVGFAVGLGNVWRFPYLCYKNGGGVFLIPYVLIALVGGIPIFFLEISLGQFMKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 29294 - protein, 1177 aa, Homo sapiens
MAGIFKEFFFSTEDLPEVILTLSLISSIGAFLNRHLEDFPIPVPVILFLLGCSFEVLSFTSSQVQRYANAIQWMSPDLFFRIFTPVVFFTTAFDMDTYMLQKLFWQILLISIPGFLVNYILVLWHLASVNQLLLKPTQWLLFSAILVSSDPMLTAAAIRDLGLSRSLISLINGESLMTSVISLITFTSIMDFDQRLQSKRNHTLAEEIVGGICSYIIASFLFGILSSKLIQFWMSTVFGDDVNHISLIFSILYLIFYICELVGMSGIFTLAIVGLLLNSTSFKAAIEETLLLEFWTFLSRIAFLMVFTFFGLLIPAHTYLYIEFVDIYYSLNIYLTLIVLRFLTLLLISPVLSRVGHEFSWRWIFIMVCSEMKGMPNINMALLLAYSDLYFGSDKEKSQILFHGVLVCLITLVVNRFILPVAVTILGLRDATSTKYKSVCCTFQHFQELTKSAASALKFDKDLANADWNMIEKAITLENPYMLNEEETTEHQKVKCPHCNKEIDEIFNTEAMELANRRLLSAQIASYQRQYRNEILSQSAVQVLVGAAESFGEKKGKCMSLDTIKNYSESQKTVTFARKLLLNWVYNTRKEKEGPSKYFFFRICHTIVFTEEFEHVGYLVILMNIFPFIISWISQLNVIYHSELKHTNYCFLTLYILEALLKIAAMRKDFFSHAWNIFELAITLIGILHVILIEIDTIKYIFNETEVIVFIKVVQFFRILRIFKLIAPKLLQIIDKRMSHQKTFWYGILKGYVQGEADIMTIIDQITSSKQIKQMLLKQVIRNMEHAIKELGYLEYDHPEIAVTVKTKEEINVMLNMATEILKAFGLKGIISKTEGAGINKLIMAKKKEVLDSQSIIRPLTVEEVLYHIPWLDKNKDYINFIQEKAKVVTFDCGNDIFEEGDEPKGIYIIISGMVKLEKSKPGLGIDQMVESKEKDFPIIDTDYMLSGEIIGEINCLTNEPMKYSATCKTVVETCFIPKTHLYDAFEQCSPLIKQKMWLKLGLAITARKIREHLSYEDWNYNMQLKLSNIYVVDIPMSTKTDIYDENLIYVILIHGAVEDCLLRKTYRAPFLIPITCHQIQSIEDFTKVVIIQTPINMKTFRRNIRKFVPKHKSYLTPGLIGSVGTLEEGIQEERNVKEDGAHSAATARSPQPCSLLGTKFNCKESPRINLRKVRKE

SEQ ID NO: 29295 - protein, 710 aa, Homo sapiens
MQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYYDDHVRRKDSSLYIGILFTMLVFGPACGFILGSFCTKIYVDAVFIDTSNLDITPDDPRWIGAWWGGFLLCGALLFFSSLLMFGFPQSLPPHSDPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTSEFFASTLTLDNLGRDPVPANQTHRTKFIYNLEDHEWCENMESVL

SEQ ID NO: 29296 - protein, 719 aa, Homo sapiens
  VARIANT 174: Xaa = Any Amino Acid
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKSYDISSGLVAIFIAFYGDRKKVIWXVASSFLIGLGSLLCAFPSINEENKQSKVGIEDICEEIKVVSGCQSSGISFQSKYLSFFILGQTVQGIAGMPLYILGITFIDENVATHSAGIYLGIAECTSMIGYALGYVLGAPLVKVPENTTSATNTTVNNGSPEWLWTWWINFLFAAVVAWCTLIPLSCFPNNMPGSTRIKARKRKQLHFFDSRLKDLKLGTNIKDLCAALWILMKNPVLICLALSKATEYLVIIGASEFLPIYLENQFILTPTVATTLAGLVLIPGGALGQLLGGVIVSTLEMSCKALMRFIMVTSVISLILLVFIIFVRCNPVQFAGINEDYDGTGKLGNLTAPCNEKCRCSSSIYSSICGRDDIEYFSPCFAGCTYSKAQNQKKMYYNCSCIKEGLITADAEGDFIDARPGKCDAKCYKLPLFIAFIFSTLIFSGFSGVPIVLAMTRVVPDKLRSLALGVSYVILRIFGTIPGPSIFKMSGETSCILRDVNKCGHTGRCWIYNKTKMAFLLVGICFLCKLCTIIFTTIAFFIYKRRLNENTDFPDVTVKNPKVKKKEETDL

SEQ ID NO: 29297 - protein, 1235 aa, Homo sapiens
MAHLELLLVENFKSWRGRQVIGPFRRFTCIIGPNGSGKSNVMDALSFVMGEKIANLRVKNIQELIHGAHIGKPISSSASVKIIYVEESGEEKTFARIIRGGCSEFRFNDNLVSRSVYIAELEKIGIIVKAQNCLVFQGTVESISVKKPKERTQFFEEISTSGELIGEYEEKKRKLQKAEEDAQFNFNKKKNIAAERRQAKLEKEEAERYQSLLEELKMNKIQLQLFQLYHNEKKIHLLNTKLEHVNRDLSVKRESLSHHENIVKARKKEHGMLTRQLQQTEKELKSVETLLNQKRPQYIKAKENTSHHLKKLDVAKKSIKDSEKQCSKQEDDIKALETELADLDAAWRSFEKQIEEEILHKKRDIELEASQLDRYKELKEQVRKKVATMTQQLEKLQWEQKTDEERLAFEKRRHGEVQGNLKQIKEQIEDHKKRIEKLEEYTKTCMDCLKEKKQQEETLVDEIEKTKSRMSEFNEELNLIRSELQNAGIDTHEGKRQQKRAEVLEHLKRLYPDSVFGRLFDLCHPIHKKYQLAVTKVFGRFITAIVVASEKVAKDCIRFLKEERAEPETFLALDYLDIKPINERLRELKGCKMVIDVIKTQFPQLKKVIQFVCGNGLVCETMEEARHIALSGPERQKTVALDGTLFLKSGVISGGSSDLKYKARCWDEKELKNLRDRRSQKIQELKGLMKTLRKETDLKQIQTLIQGTQTRLKYSQNELEMIKKKHLVAFYQEQSQLQSELLNIESQCIMLSEGIKERQRRIKEFQEKIDKVEDDIFQHFCEEIGVENIREFENKHVKRQQEIDQKRLEFEKQKTRLNVQLEYSRSHLKKKLNKINTLKETIQKGSEDIDHLKKAEENCLQTVNELMAKQQQLKDIRVTQNSSAEKVQTQIEEERKKFLAVDREVGKLQKEVVSIQTSLEQKRLEKHNLLLDCKVQDIEIILLSGSLDDIIEVEMGTEAESTQATIDIYEKEEAFEIDYSSLKEDLKALQSDQEIEAHLRLLLQQVASQEDILLKTAAPNLRALENLKTVRDKFQESTDAFEASRKEARLCRQEFEQVKKRRYDLFTQCFEHVSISIDQIYKKLCRNNSAQAFLSPENPEEPYLEGISYNCVAPGKRFMPMDNLSGGEKCVAALALLFAVHSFRPAPFFVLDEVDAALDNTNIGKVSSYIKEQTQDQFQMIVISLKEEFYSRADALIGIYPEYDDCMFSRVLTLDLSQYPDTEGQESSKRHGESR

SEQ ID NO: 29298 - protein, 211 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 29299 - protein, 158 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNSITNDAREDEMEENLTQVGSILGNLKDMALNIGNEIDAQNPQIKRITDKADTNRDRIDIANARAKKLIDS

SEQ ID NO: 29300 - protein, 258 aa, Homo sapiens
MSAYPKSYNPFDDDGEDEGARPAPWRDARDLPDGPDAPADRQQYLRQEVLRRAEATAASTSRSLALMYESEKVGVASSEELARQRGVLERTEKMVDKMDQDLKISQKHINSIKSVFGGLVNYFKSKPVETPPEQNGTLTSQPNNRLKEAISTSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTERKVRQL

SEQ ID NO: 29301 - protein, 535 aa, Homo sapiens
MKKISLKTLRKSFNLNKSKEETDFMVVQQPSLASDFGKDDSLFGSCYGKDMASCDINGEDEKGGKNRSKSESLMGTLKRRLSAKQKSKGKAGTPSGSSADEDTFSSSSAPIVFKDVRAQRPIRSTSLRSHHYSPAPWPLRPTNSEETCIKMEVRVKALVHSSSPSPALNGVRKDFHDLQSETTCQEQANSLKSSASHNGDLHLHLDEHVPVVIGLMPQDYIQYTVPLDEGMYPLEGSRSYCLDSSSPMEVSAVPPQVGGRAFPEDESQVDQDLVVAPEIFVDQSVNGLLIGTTGVMLQSPRAGHDDVPPLSPLLPPMQNNQIQRNFSGLTGTEAHVAESMRCHLNFDPNSAPGVARVYDSVQSSGPMVVTSLTEELKKLAKQGWYWGPITRWEAEGKLANVPDGSFLVRDSSDDRYLLSLSFRSHGKTLHTRIEHSNGRFSFYEQPDVEGHTSIVDLIEHSIRDSENGAFCYSRSRLPGSATYPVRLTNPVSRFMQVRSLQYLCRFVIRQYTRIDLIQKLPLPNKMKDYLQEKHY

SEQ ID NO: 29302 - protein, 1222 aa, Homo sapiens
MEAARTERPAGRPGAPLVRTGLLLLSTWVLAGAEITWDATGGPGRPAAPASRPPALSPLSPRAVASQWPEELASARRAAVLGRRAGPELLPQQGGGRGGEMQVEAGGTSPAGERRGRGIPAPAKLGGARRSRRAQPPITQERGDAWATAPADGSRGSRPLAKGSREEVKAPRAGGSAAEDLRLPSTSFALTGDSAHNQAMVHWSGHNSSVILILTKLYDFNLGSVTESSLWRSTDYGTTYEKLNDKVGLKTVLSYLYVNPTNKRKIMLLSDPEMESSILISSDEGATYQKYRLTFYIQSLLFHPKQEDWVLAYSLDQKLYSSMDFGRRWQLMHERITPNRFYWSVAGLDKEADLVHMEVRTTDGYAHYLTCRIQECAETTRSGPFARSIDISSLVVQDEYIFIQVTTSGRASYYVSYRREAFAQIKLPKYSLPKDMHIISTDENQVFAAVQEWNQNDTYNLYISDTRGIYFTLAMENIKSSRGLMGNIIIELYEVAGIKGIFLANKKVDDQVKTYITYNKGRDWRLLQAPDVDLRGSPVHCLLPFCSLHLHLQLSENPYSSGRISSKETAPGLVVATGNIGPELSYTDIGVFISSDGGNTWRQIFDEEYNVWFLDWGGALVAMKHTPLPVRHLWVSFDEGHSWDKYGFTSVPLFVDGALVEAGMETHIMTVFGHFSLRSEWQLVKVDYKSIFSRHCTKEDYQTWHLLNQGEPCVMGERKIFKKRKPGAQCALGRDHSGSVVSEPCVCANWDFECDYGYERHGESQCVPAFWYNPASPSKDCSLGQSYLNSTGYRRIVSNNCTDGLREKYTAKAQMCPGKAPRGLHVVTTDGRLVAEQGHNATFIILMEEGDLQRTNIQLDFGDGIAVSYANFSPIEDGIKHVYKSAGIFQVTAYAENNLGSDTAVLFLHVVCPVEHVHLRVPFVAIRNKEVNISAVVWPSQLGTLTYFWWFGNSTKPLITLDSSISFTFLAEGTDTITVQVAAGNALIQDTKEIAVHEYFQSQLLSFSPNLDYHNPDIPEWRKDIGNVIKRALVKVTSVPEDQILIAVFPGLPTSAELFILPPKNLTERRKGNEGDLEQIVETLFNALNQNLVQFELKPGVQVIVYVTQLTLAPLVDSSAGHSSSAMLMLLSVVFVGLAVFLIYKFKRKIPWINIYAQVQHDKEQEMIGSVSQSENAPKITLSDFTEPEELLDKELDTRVIGGIATIANSESTKEIPNCTSV

SEQ ID NO: 29303 - protein, 151 aa, Homo sapiens
MSIPFSNTHYRIPQGFGNLLEGLTREILREQPDNIPAFAAAYFESLLEKREKTNFDPAEWGSKVEDRFYNNHAFEEQEPPEKSDPKQEESQISGKEEETSVTILDSSEEDKEKEEVAAVKIQAAFRGHIAREEAKKMKTNSLQNEEKEENK

SEQ ID NO: 29304 - protein, 103 aa, Homo sapiens
MRQRLLPSVTSLLLVALLFPGSSQARHVNHSATEALGELRERAPGQGTNGFQLLRHAVKRDLLPPRTPPYQVHISHREARGPSFRICVDFLGPRWARGCSTGN

SEQ ID NO: 29305 - protein, 108 aa, Homo sapiens
MRQRLLPSVTSLLLVALLFPGSSQARHVNHSATEALGELRERAPGQGTNGFQLLRHAVKRDLLPPRTPPYQGDVPPGIRNTICRMQQGICRLFFCHSGTGQQHRQRCG

SEQ ID NO: 29306 - protein, 133 aa, Homo sapiens
MRQRLLPSVTSLLLVALLFPGSSQARHVNHSATEALGELRERAPGQGTNGFQLLRHAVKRDLLPPRTPPYQGDVPPGIRNTICRMQQGICRLFFCHSGEKKRDICSDPWNRCCVSNTDEEGKEKPEMDGRSGI

SEQ ID NO: 29307 - protein, 82 aa, Homo sapiens
MRQRLLPSVTSLLLVALLFPGSSQARHVNHSATEALGELRERAPGQGTNGFQLLRHAVKRDLLPPRTPPYQGTGQQHRQRCG

SEQ ID NO: 29308 - protein, 113 aa, Homo sapiens
MRQRLLPSVTSLLLVALLFPGSSQARHVNHSATEALGELRERAPGQGTNGFQLLRHAVKRDLLPPRTPPYQEPASDLKVVDCRRSEGFCQEYCNYMETQVGYCSKKKDACCLH

SEQ ID NO: 29309 - protein, 50 aa, Homo sapiens
MKVFFLFAVLFCLVQTNSVHISHREARGPSFRICVDFLGPRWARGCSTGN

SEQ ID NO: 29310 - protein, 80 aa, Homo sapiens
MKVFFLFAVLFCLVQTNSGDVPPGIRNTICRMQQGICRLFFCHSGEKKRDICSDPWNRCCVSNTDEEGKEKPEMDGRSGI

SEQ ID NO: 29311 - protein, 379 aa, Homo sapiens
MPRSSRSPGDPGALLEDVAHNPRPRRIAQRGRNTSRMAEDTSPNMNDNILLPVRNNDQALGLTQCMLGCVSWFTCFACSLRTQAQQVLFNTCRCKLLCQKLMEKTGILLLCAFGFWMFSIHLPSKMKVWQDDSINGPLQSLRLYQEKVRHHSGEIQDLRGSMNQLIAKLQEMEAMSDEQKMAQKIMKMIHGDYIEKPDFALKSIGASIDFEHTSVTYNHEKAHSYWNWIQLWNYAQPPDVILEPNVTPGNCWAFEGDRGQVTIQLAQKVYLSNLTLQHIPKTISLSGSLDTAPKDFVIYGMEGSPKEEVFLGAFQFQPENIIQMFPLQNQPARAFSAVKVKISSNWGNPGFTCLYRVRVHGSVAPPREQPHQNPYPKRD

SEQ ID NO: 29312 - protein, 141 aa, Homo sapiens
MEQPTSSTNGEKTKSPCESNNKKNDEMQEVPNRVLAPEQSLKKTKTSEYPIIFVYYLRKGKKINSNQLENEQSQENSINPIQKEEDEGVDLSEGSSNEDEDLGPCEGPSKEDKDLDSSEGSSQEDEDLGLSEGSSQDSGED

SEQ ID NO: 29313 - protein, 569 aa, Homo sapiens
MDAGSSRSLENAVNRIYHDQLVPKINTSKKMSTLAHPPNILEMSQEIKKNCGGKQVEITLERTKMTKGIKEKQSNDLEKAAFKRKAEGEEKPTRKKQAKITELDNQLITMPLPHIPLKNIMDVEMKLVYIDEMGVRYEFVESFMSTGSQPTCQAAEIVDPLSVHNFSFLPQIDKWLQVALKDASSCYRQKKYALAAGQFRTALELCSKGAVLGEPFDAPAEDIASVASFIETKLVTCYLRMRKPDLALNHAHRSIVLNPAYFRNHLRQATVFRCLERYSEAARSAVIADYMFWLGGGREESISKLIKLYWQAMIEEAITRAESFSVMYTPFATKIRADKIEKVKDAFTKTHPAYAEYMYTDLQALHMLPQTVDWSSFPPQQYLLTLGFKNKDDGKFLEKISSRKLPIFTEHKTPFGLTREDTVRQMETMGKRILPILDFIRSTQLNGSFPASSGVMEKLQYASLLSQLQRVKEQSQVINQAMAELATIPYLQDISQQEAELLQSLMADAMDTLEGRRNNNERVWNMIQKVGQIEDFLYQLEDSFLKTKKLRTARRQKTKMKRLQTVQQR

SEQ ID NO: 29314 - protein, 538 aa, Homo sapiens
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQDTFDRERHKDPSPRDRDMQQLDSNLNSTRSQCNQVQDDLVETEKNLEESKNRSAISLLAAEEEINQLKKQLKSLQAQEDARHRNTDQRSSENRRSEPWSLEERKREQWNSLKQNADQQDTEAMSDYKKQLRNLKEEIAVLSAEKSALQGRSSRSRSPSPAPRSRSCSRSRSASPSTAVKVRRPSPNRSKLSNVARKAALLSRFSDSYSQARLDAQCLLRRCIDKAETVQRIIYIATVEAFHVAKMAFRHFKIHVRKSLTPSYVGSNDFENAVLDYVICHLDLYDSQSSVNDVIRAMNVNPKISFPPVVDFCLLSDFIQEICCIAFAMQALEPPLDIAYGADGEVFNDCKYRRSYDSDFTAPLVLYHVWPALMENDCVIMKGEAVTRRGAFWNSVRSVSRCRSRSLSPICPRSQIGLNTMSRSRSPSPIRCGLPRF

SEQ ID NO: 29315 - protein, 363 aa, Homo sapiens
MKRSLSENSARSTAGCLPVPLFNQKKRNRQPLTSNPLKDDSGISTPSDNYDFPPLPTDWAWEAVNPELAPVMKTVDTGQIPHSASRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 29316 - protein, 105 aa, Homo sapiens
MAPAGMSGAQDNSCLYQEIAPSFQRLPCPRTSSRHFSEAMTCPCGWRPFKGGPGGLKGPVWPAKEENSCSHGRIQRVQRRRVPSASPLIQKINRRSVLFHPYCWS

SEQ ID NO: 29317 - protein, 286 aa, Homo sapiens
MRHNQMCCETPPTVTVYVKSGSNRSHQPKKPITLKRPICKDNWQAFEKNTHNNNKSKRPKGPCLVIQRQDMTAFFKLFDDDLIQDFLWMDCCCKIADKYLLAMTFVYFKRAKFTISEHTRINFFIALYLANTVEEDEEETKYEIFPWALGKNWRKLFPNFLKLRDQLWDRIDYRAIVSRRCCEEVMAIAPTHYIWQRERSVHHSGAVRNYNRDEVQLPRGPSATPVDCSLCGKKRRYVRLGLSSSSSLSSHTAGVTEKHSQDSYNSLSMDIIGDPSQAYTGSEGMI

SEQ ID NO: 29318 - protein, 313 aa, Homo sapiens
MRHNQMCCETPPTVTVYVKSGSNRSHQPKKPITLKRPICKDNWQAFEKNTHNNNKSKRPKGPCLVIQRQDMTAFFKLFDDDLIQDFLWMDCCCKIADKYLLAMTFVYFKRAKFTISEHTRINFFIALYLANTVEEDEEETKYEIFPWALGKNWRKLFPNFLKLRDQLWDRIDYRAIVSRRCCEEVMAIAPTHYIWQRERSVHHSGAVRNYNRDEVQLPRGPSATPVDCSLCGKKRRYVRLGLSSSSSLSSHTAGVTEKHSQDSYNSLSMDIIGDPSQAYTGSEVVNDHQSNKGKKTNFLKKDKSMEWFTGSEE

SEQ ID NO: 29319 - protein, 84 aa, Homo sapiens
MALSVLRLALLLLAVTFAASLIPQFGLFSKYRTPNCSQYRLPGCPRHFNPVCGSDMSTYANECTLCMKIREGGHNIKIIRNGPC

SEQ ID NO: 29320 - protein, 133 aa, Homo sapiens
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 29321 - protein, 117 aa, Homo sapiens
MLSKAHGCKTALSLGRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 29322 - protein, 583 aa, Homo sapiens
  VARIANT 16: Xaa = Any Amino Acid
MANTVEADGSNDEGYXAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 29323 - protein, 63 aa, Homo sapiens
MDPALAAQMSEAVAEKMLQYRRDTAGWKICREGVPRRRHCIWDTRGGVGLCEASCWRPTSEVG

SEQ ID NO: 29324 - protein, 213 aa, Homo sapiens
MDPALAAQMSEAVAEKMLQYRRDTAGWKICREGNGVSVSWRPSVEFPGNLYRGEGIVYGTLEEVWDCVKPAVGGLRVKWDENVTGFEIIQSITDTLCVSRTSTPSAAMKLISPRDFVDLVLVKRYEDGTISSNATHVEHPLCPPKPGFVRGFNHPCGCFCEPLPGEPTKTNLVTFFHTDLSGYLPQNVVDSFFPRSMTRFYANLQKAVKQFHE

SEQ ID NO: 29325 - protein, 146 aa, Homo sapiens [sequence omitted]

SEQ ID NO: 29326 - protein, 1019 aa, Homo sapiens
MWVQGHSSRASATESVSFSGIVQMDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 29327 - protein, 996 aa, Homo sapiens
MDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKFKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKCMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAAQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 29328 - protein, 328 aa, Homo sapiens
MSAAGLLAPAPAQAGAPPAPEYYPEEDEELESAEDDERSCRGRESDEDTEDASETDLAKHDEEDYVEMKEQMYQDKLASLKRQLQQLQEGTLQEYQKRMKKLDQQYKERIRNAELFLQLETEQVERNYIKEKKAAVKEFEDKKVELKENLIAELEEKKKMIENEKLTMELTGDSMEVKPIMTRKLRRRPNDPVPIPDKRRKPAPAQLNYLLTDEQIMEDLRTLNKLKSPKRPASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 29329 - protein, 357 aa, Homo sapiens
MSGKTKARRAAMFFRRCSEDASGSASGNALLSEDENPDANGVTRSWKIILSTMLTLTFLLVGLLNHQWLKETDVPQKSRQLYAIIAEYGSRLYKYQARLRMPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 29330 - protein, 357 aa, Homo sapiens; identical to SEQ ID NO: 29329

SEQ ID NO: 29331 - protein, 350 aa, Homo sapiens
MEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIFVENTVDLEGPPSDFYYINEYKPAPGISLVNEATFGCSCTDCFFQKCCPAEAGVLLAYNKNQQIKIPPGTPIYECNSRCQCGPDCPNRIVQKGTQYSLCIFRTSNGRGWGVKTLVKIKRMSFVMEYVGEVITSEEAERRGQFYDNKGITYLFDLDYESDEFTVDAARYGNVSHFVNHSCDPNLQVFNVFIDNLDTRLPRIALFSTRTINAGEELTFDYQMKGSGDISSDSIDHSPAKKRVRTVCKCGAVTCRGYLN

SEQ ID NO: 29332 - protein, 976 aa, Homo sapiens
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKKDKKTQTFLLETPEIYWKLDSKAVPSQTVSRNFTSVDHGISKDKRDYLWTSAKNTLSTPLPKAYTVKTPTKPKLQQRENLNIPIEESKKKRKMAFEFDINSDSSETTDLLSMVSEEETLKTLYRNNNPPASHLCVKTPKKAPSSLTTPGSTLKFGAIRKMREDRWAVIAKMDRKKKLKEAEKLFV

SEQ ID NO: 29333 - protein, 635 aa, Homo sapiens
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQGQALEQAIISQKPQLEKLIATTAHEKMPWFHGKISREESEQIVLIGSKTNGKFLIRARDNNGSYALCLLHEGKVLHYRIDKDKTGKLSIPEGKKFDTLWQLVEHYSYKADGLLRVLTVPCQKIGTQGNVNFGGRPQLPGSHPATWSAGGIISRIKSYSFPKPGHRKSSPAQGNRQESTVSFNPYEPELAPWAADKGPQREALPMDTEVYESPYADPEEIRPKEVYLDRKLLTLEDKELGSGNFGTVKKGYYQMKKVVKTVAVKILKNEANDPALKDELLAEANVMQQLDNPYIVRMIGICEAESWMLVMEMAELGPLNKYLQQNRHVKDKNIIELVHQVSMGMKYLEESNFVHRDLAARNVLLVTQHYAKISDFGLSKALRADENYYKAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 29334 - protein, 421 aa, Homo sapiens
MAEQLALVIGGTIGGLLLLLLIGASCCLWRRFCATLTYEELPGTPAMATTAASSGQRDRPCQPHARTQLSRPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKSQQLGRVVVGPYMYTRGRELEHWDEMLSKPKELVKRWHALCRTTEP

SEQ ID NO: 29335 - protein, 336 aa, Homo sapiens
MTTLSPENSLSARQSASFILVKRKPPIDKTEWDSFFDESGHLAKSRDFICVNILERGLHPFVRTEAWKFLTGYFSWQSSQDERLTVDSMRRKNYKALCQMYEKIQPLLENLHRNFTETRNNIARDIQKIYDKDPLGNVLIDKKRLEKILLLSYVCNTQAEYQQGFHEMMMLFQLMVEHDHETFWLFQFFLQKTEHSCVINIGVAKNLDMLSTLITFLDPVFAEHLKGKGAGAVQSLFPWFCFCFQRAFKSFDDVWRLWEVLLTGKPCRNFQVLVAYSMLQMVREQVLQESMGGDDILLACNNLIDLDADELISAACVVYAELIQKDVPQTLKDFFL

SEQ ID NO: 29336 - protein, 339 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 29337 - protein, 215 aa, Homo sapiens
MLAGQLEARDPKEGTHPEDPCPGAGAVMEKTAVAAEVLTEDCNTGEMPPLQQQIIRLHQELGRQKSLWADVHGKLRSHIDALREQNMELREKLRALQLQRWKARKKSAASPHAGQESHTLALEPAFGKISPLSADEETIPKYAGHKNQSATLLGQRSSSNNSAPPKPMSLKIERISSWKTPPQENRDKNLSRRRQDRRATPTGRPTPCAERRGGV

SEQ ID NO: 29338 - protein, 441 aa, Homo sapiens
MAPKGILGSFPTAMNLSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 29339 - protein, 425 aa, Homo sapiens
MASSIICQEHCQISGQAKIDILLVGDVTVGYLADTVQKLFANIAEVTITISDTKEAAALLDDCIFNMVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKENLRRERIKYCCEQLRTLLPYVKGRKNDAASVLEATVDYVKYIREKISPAVMAQITEALQSNMRFCKKQQTPIELSLPGTVMAQRENSVMSTYSPERGLQFLANTCWNGCSTPDAESSLDEAVRVPSSSASENAIGDPYKTHISSAALSLNSLHTVRYYSKVTPSYDATAVTNQNISIHLPSAMPPVSKLLPRYCTSGLGQTCTTHPNCLQQFWAY

SEQ ID NO: 29340 - protein, 1451 aa, Homo sapiens
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSTSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 29341 - protein, 1491 aa, Homo sapiens
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSHQSMQSTCSPESSEDITDEFLTPDGEYFYSSTAQENLALETSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 29342 - protein, 379 aa, Homo sapiens
MGDSRRRSLGNQPSSEAAGRSEREQDGDPRGLQSSVYESRRVTDPERQDLDNAELGPEDPEEELPPEEVAGEEFPETLDPKEALSELERVLDKDLEEDIPEISRLSISQKLPSTTMTKARKRRRRRRLMELAEPKINWQVLKDRKGRCGKGYAWISPCKMSLHFCLCWPSVYWTERFLEDTTLTITVPAVSRRVEELSRPKRFYLEYYNNNRTTPVWPIPRSSLEYRASSRLKELAAPKIRDNFWSMPMSEVSQVSRAAQMAVPSSRILQLSKPKAPATLLEEWDPVPKPKPHVSDHNRLLHLARPKAQSDKCVPDRDPRWEVLDVTKKVVASPRIISLAKPKVRKGLNEGYDRRPLASMSLPPPKASPEKCDQPRPGL

SEQ ID NO: 29343 - protein, 355 aa, Homo sapiens
MGDSRRRSLGNQPSSEAAGRSEREQDGDPRGLQSSVYESRRVTDPERQDLDNAELGPEDPEEELPPEEVAGEEFPETLDPKEALSELERVLDKDLEEDIPEISRLSISQKLPSTTMTKARKRRRRRRLMELAEPKINWQVLKDRPSVYWTERFLEDTTLTITVPAVSRRVEELSRPKRFYLEYYNNNRTTPVWPIPRSSLEYRASSRLKELAAPKIRDNFWSMPMSEVSQVSRAAQMAVPSSRILQLSKPKAPATLLEEWDPVPKPKPHVSDHNRLLHLARPKAQSDKCVPDRDPRWEVLDVTKKVVASPRIISLAKPKVRKGLNEGYDRRPLASMSLPPPKASPEKCDQPRPGL

SEQ ID NO: 29344 - protein, 351 aa, Homo sapiens
MAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETGDKLWEVQCESPTFTVAWHPKRPLLAFACDDKDGKYDSSREAGTVKLFGLPNDS

SEQ ID NO: 29345 - protein, 378 aa, Homo sapiens
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSAESTSADTVLLTSKESKVWDLPSTSHVSMWKTSDSVSSPQPGASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 29346 - protein, 626 aa, Homo sapiens
MMANDAKPDVKTVQVLRDTANRLRIHSIRATCASGSGQLTSCCSAAEVVSVLFFHTMKYKQTDPEHPDNDRFILSRGHAAPILYAAWVEVGDISESDLLNLRKLHSDLERHPTPRLPFVDVATGSLGQGLGTACGMAYTGKYLDKASYRVFCLMGDGESSEGSVWEAFAFASHYNLDNLVAVFDVNRLGQSGPAPLEHGADIYQNCCEAFGWNTYLVDGHDVEALCQAFWQASQVKNKPTAIVAKTFKGRGIPNIEDAENWHGKPVPKERADAIVKLIESQIQTNENLIPKSPVEDSPQISVTDIKMTSPHAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 29347 - protein, 288 aa, Homo sapiens
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKKYQETLKKIEEELEALFLEREVSKLVSMNPVEKEHTSQNNEGTPTQKTARLFSKKIFCCLFFITLFFIRLLSYMFFHVRFINPDLLVNVLPKVLGRSTLWKLRCFFFPSLTLETEDMLPH

SEQ ID NO: 29348 - protein, 168 aa, Homo sapiens
MRLTEKSEGEQQLKPNNSNAPNEDQEEEIQQSEQHTPARQRTQRADTQPSRCRLPSRRTPTTSSDRTINLLEVLPWPTEWIFNPYRLPALFELYPEFLLVFKEAFHDISHCLKAQMEKIGLPIILHLFALSTLYFYKFFLPTILSLSFFILLVLLLLLFIIVFILIFF

SEQ ID NO: 29349 - protein, 555 aa, Homo sapiens
MVAACRSVAGLLPRRRRCFPARAPLLRVALCLLCWTPAAVRAVPELGLWLETVNDKSGPLIFRKTMFNSTDIKLSVKSFHCSGPVKFTIVWHLKYHTCHNEHSNLEELFQKHKLSVDEDFCHYLKNDNCWTTKNENLDCNSDSQVFPSLNNKELINIRNVSNQERSMDVVARTQKDGFHIFIVSIKTENTDASWNLNVSLSMIGPHGYISASDWPLMIFYMVMCIVYILYGILWLTWSACYWKDILRIQFWIAAVIFLGMLEKAVFYSEYQNISNTGLSTQGLLIFAELISAIKRTLARLLVIIVSLGYGIVKPRLGTVMHRVIGLGLLYLIFAAVEGVMRVIGGSNHLAVVLDDIILAVIDSIFVWFIFISLAQTMKTLRLRKNTVKFSLYRHFKNTLIFAVLASIVFMGWTTKTFRIAKCQSDWMERWVDDAFWSFLFSLILIVIMFLWRPSANNQRYAFMPLIDDSDDEIEEFMVTSENLTEGIKLRASKSVSNGTAKPATSENFDEDLKWVEENIPSSFTDVALPVLVDSDEEIMTRSEMAEKMFSSEKIM

SEQ ID NO: 29350 - protein, 184 aa, Homo sapiens
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACPLPLLSPAGGSTTLYNCSTCKGTEVSCWPRKRCFPGSQDLWEAKILLLSIFGAFLLLGVLSLLVESHHLQAKSGL

SEQ ID NO: 29351 - protein, 189 aa, Homo sapiens
MVGILPLCCSGCVPSLCCSSYVPSVAPTAAHSVRVPHSAGHCGQRVLACSLPQVFLKPWIFVEHFSSWLSLELFSFLRYLGTLLCACGHRLREGRLLPCLLGVGSWLLFNNWTGGSWFSLHLQQVSLSQGSHVAAFLPEAIGPGVPVPVSGESTSAQQSHAGWQLSAEADACPSVLYSEVLEWNKNINT

SEQ ID NO: 29352 - protein, 348 aa, Homo sapiens
MRLGLLSVALLFVGSSHLYSDHYSPSGRHRLGPSPEPAASSQQAEAVRKRLRRRREGGAHAKDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRGDSGGPLMCYLPEYKRFFVMGITSYGHGCGRRGFPGVYIGPSFYQKWLTEHFFHASTQGILTINILRGQILIALCFVILLATT

SEQ ID NO: 29353 - protein, 55 aa, Homo sapiens
MSTSRKLKSHGMRRSKSRSPHKGVKRGGSKRKYRKGNLKSRKRGDDANRNYRSHL

SEQ ID NO: 29354 - protein, 138 aa, Homo sapiens
MDTQTHSLPITHTQLHSNSQPQSRTCTRHCQTFSQSCRQSHRGSRSQSSSQSPASHRNPTGAHSSSGHQSQSPNTSPPPKRHKKTMNSHHSPMRPTILHCRCPKNRKNLEGKLKKKKMAKRIQQVYKTKTRSSGWKSN

SEQ ID NO: 29355 - protein, 457 aa, Homo sapiens
MEFLLGNPFSTPVGQCLEKATDGSLQSEDWTLNMEICDIINETEEGPKDAIRALKKRLNGNRNYREVMLALTAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 29356 - protein, 462 aa, Homo sapiens
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 29357 - protein, 132 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATLRSFEGNPKGEGSRI

SEQ ID NO: 29358 - protein, 140 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATLRSFEGLMGTIKSKVSGGKRAWP

SEQ ID NO: 29359 - protein, 551 aa, Homo sapiens
MNESPDPTDLAGVIIELGPNDSPQTSEFKGATEEAPAKESPHTSEFKGAARVSPISESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVETPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 29360 - protein, 533 aa, Homo sapiens
MNESPDPTDLAGVIIELGPNDSPQTSEFKGATEEAPAKESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVETPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 29361 - protein, 513 aa, Homo sapiens
MNESPDPTDLAGVIIELGPNDSPQTSEFKGATEEAPAKESSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVETPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 29362 - protein, 413 aa, Homo sapiens
MDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVETPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 29363 - protein, 564 aa, Homo sapiens
MAELDLMAPGPLPRATAQPPAPLSPDSGSPSPDSGSASPVEEEDVGSSEKLGRETEEQDSDSAEQGDPAGEGKEVLCDFCLDDTRRVKAVKSCLTCMVNYCEEHLQPHQVNIKLQSHLLTEPVKDHNWRYCPAHHSPLSAFCCPDQQCICQDCCQEHSGHTIVSLDAARRDKEAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 29364 - protein, 728 aa, Homo sapiens
MSESGEMSEFGYIMELIAKGKVTIKNIERELICPACKELFTHPLILPCQHSICHKCVKELLLTLDDSFNDVGSDNSNQSSPRLRLPSPSMDKIDRINRPGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVDFYDMDQMKCLYERQVDCSHTLYPAFALMGSGGIQLEEPITAKYLEYQEDM

SEQ ID NO: 29365 - protein, 432 aa, Homo sapiens
MDEAVGDLKQALPCVAESPTVHVEVHQRGSSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDEVESLTAARNACRAGTEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLNDISRKSEGLSGRVLRKLPFLAHALYVQAPTVTIEGFLQALSLAVDKQFEERKKLAAYI

SEQ ID NO: 29366 - protein, 509 aa, Homo sapiens
MVLWILWRPFGFSGRFLKLESHSITESKSLIPVAWTSLTQMLLEAPGIFLLGQRKRFSTMPETETHERETELFSPPSDVRGMTKLDRTAFKKTVNIPVLKVRKEIVSKLMRSLKRAALQRPGIRRVIEDPEDKESRLIMLDPYKIFTHDSFEKAELSVLEQLNVSPQISKYNLELTYEHFKSEEILRAVLPEGQDVTSGFSRIGHIAHLNLRDHQLPFKHLIGQVMIDKNPGITSAVNKINNIDNMYRNFQMEVLSGEQNMMTKVRENNYTYEFDFSKVYWNPRLSTEHSRITELLKPGDVLFDVFAGVGPFAIPVAKKNCTVFANDLNPESHKWLLYNCKLNKVDQKVKVFNLDGKDFLQGPVKEELMQLLGLSKERKPSVHVVMNLPAKAIEFLSAFKWLLDGQPCSSEFLPIVHCYSFSKDANPAEDVRQRAGAVLGISLEACSSVHLVRNVAPNKEMLCITFQIPASVLYKNQTRNPENHEDPPLKRQRTAEAFSDEKTQIVSNT

SEQ ID NO: 29367 - protein, 592 aa, Homo sapiens
MASVVVKTIWQSKEIHEAGDTPTGVESCSQLVPEAPRRVTSRAKGIPKKKKAVSFHGVEPQMSHQPMHWCLNLKRSSACTNVSLLNLAAMEPTDSTGTDSTVEDLSGQLTLAGPPASPTLPWDPDDADITEILSGVNSGLVRAKDSITSLKEKTNRVNQHVQSLQSECSVLSENLERRRQEAEELEGYCIQLKENCWKVTRSVEDAEIKTNVLKQNSALLEEKLRYLQQQLQDETPRRQEAELQEPEEKQEPEEKQEPEEKQKPEAGLSWNSLGPAATSQGCPGPPGSPDKPSRPHGLVPAGWGMGPRAGEGPYVSEQELQKLFTGIEELRREVSSLTARWHQEEGAVQEALRLLGGLGGRVDGFLGQWERAQREQAQTARDLQELRGRADELCTMVERSAVSVASLRSELEGLGPLKPILEEFGRQFQNSRRGPDLSMNLDRSHQGNCARCASQGSQLSTESLQQLLDRALTSLVDEVKQRGLTPACPSCQRLHKKILELERQALAKHVRAEALSSTLRLAQDEALRAKNLLLTDKMKPEEKMATLDHLHLKMCSLHDHLSNLPLEGSTGTMGGGSSAGTPPKQGGSAPEQ

SEQ ID NO: 29368 - protein, 245 aa, Homo sapiens
MASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 29369 - protein, 308 aa, Homo sapiens [sequence omitted]

SEQ ID NO: 29370 - protein, 308 aa, Homo sapiens [sequence omitted]

SEQ ID NO: 29371 - protein, 358 aa, Homo sapiens
MDDATVLRKKGYIVGINLGKGSYAKVKSAYSERLKFNVAVKIIDRKKTPTDFVERFLPREMDILATVNHGSIIKTYEIFETSDGRIYIIMELGVQGDLLEFIKCQGALHEDVARKMFRQLSSAVKYCHDLDIVHRDLKCENLLLDKDFNIKLSDFGFSKRCLRDSNGRIILSKTFCGSAAYAAPEVLQSIPYQPKVYDIWSLGVILYIMVCGSMPYDDSDIRKMLRIQKEHRVDFPRSKNLTCECKDLIYRMLQPDVSQRLHIDEILSHSWLQPPKPKATSSASFKREGEGKYRAECKLDTKTDLRPDHRPDHKLGAKTQHRLLVVPENENRMEDRLAETSRAKDHHISGAEVGKAST

SEQ ID NO: 29372 - protein, 328 aa, Homo sapiens
MGKGDVLEAAPTTTAYHSLMDEYGYEVGKAIGHGSYGSVYEAFYTKQKVMVAVKIISKKKASDDYLNKFLPREIQVMKVLRHKYLINFYRAIESTSRVYIILELAQGGDVLEWIQRYGACSEPLAGKWFSQLTLGIAYLHSKSIVHRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKNLILQMLRQATKRATILDIIKDSWVLKFQPEQPTHEIRLLEAMCQLHNTTKQHQSLQITT

SEQ ID NO: 29373 - protein, 273 aa, Homo sapiens
MSGDKLLSELGYKLGRTIGEGSYSKVKVATSKKYKGTVAIKVVDRRRAPPDFVNKFLPRELSILRGVRHPHIVHVFEFIEVCNGKLYIVMEAAATDLLQAVQRNGRIPGVQARDLFAQIAGAVRYLHDHHLVHRDLKCENVLLSPDERRVKLTDFGFGRQAHGYPDLSTTYCGSAAYASPEVLLGIPYDPKKYDVWSMGVVLYVMVTGCMPFDDSDIAGLPRRQKRGVLYPEGLELSERCKALIAELLQFSPSARPSAGQVARNCWLRAGDSG

SEQ ID NO: 29374 - protein, 592 aa, Homo sapiens
MRGRDLCSSTQSQALGSLRTTTPAFTLNIPSEANHTEQPPAGLGARLQEAGVSIPPRRGRPTPTLEKKKKPHLMAEDEPSGALLKPLVFRVDETTPAVVQSVLLERGWNKFDKQEQNAEDWNLYWRASSFRMTEHNSVKPWQQLNHHPGTTKLTRKDCLAKHLKHMRRMYGTSLYQFIPLTFVMPNDYTKFVAEYFQERQMLGTKHSYWICKPAELSRGRGILIFSDFKDFIFDDMYIVQKYISNPLLIGRYKCDLRIYVCVTGFKPLTIYVYQEGLVRFATEKFDLSNLQNNYAHLTNSSINKSGASYEKIKEVIGHGCKWTLSRFFSYLRSWDVDDLLLWKKIHRMVILTILAIAPSVPFAANCFELFGFDILIDDNLKPWLLEVNYSPALTLDCSTDVLVKRKLVHDIIDLIYLNGLRNEGGEASNATHGNSNIDAAKSDRGGLDAPDCLPYDSLSFTSRMYNEDDSVVEKAVSVRPEAAPASQLEGEMSGQDFHLSTREMPQSKPKLRSRHTPHKTLMPYASLFQSHSCKTKTSPCVLSDRGKAPDPQAGNFVLVFPFNEATLGASRNGLNVKRIIQELQKLMNKQHS

SEQ ID NO: 29375 - protein, 1199 aa, Homo sapiens
MASAGTQHYSIGLRQKSSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDSLEDCCGRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDSIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 29376 - protein, 450 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGVDSVEAEAEEGEEY

SEQ ID NO: 29377 - protein, 520 aa, Homo sapiens
MSQDNDTLMRDILGHELAAMRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYVLRPALPGTMMQCYLTRDKHGVDKGLFPLYYLYLETSDSLQRFLLAGRKRRRSKTSNYLISLDPTLLSRDGDNFVGKVRSNVFSTKFTIFDNGVNPDREHLTRNTARIRQELGAVCYEPNVLGYLGPRKMTVILPGTNSQNQRINVQPLNEQESLLSRYQRGDKQGLLLLHNKTPSWDKENGVYTLNFHGRVTRASVKNFQIVDPKHQEHLVLQFGRVGPDTFTMDFCFPFSPLQAFSICLSSFN

SEQ ID NO: 29378 - protein, 442 aa, Homo sapiens
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 29379 - protein, 349 aa, Homo sapiens
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 29380 - protein, 486 aa, Homo sapiens
MVSHTFHMRTEESDASQEGDDLPKSSANTSHPKQDDSPKSSEETIQPKEGDIPKAPEETIQSKKEDLPKSSEKAIQPKESNIPKSSAKPIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSPEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 29381 - protein, 576 aa, Homo sapiens
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLRYFYRQLLLFYSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 29382 - protein, 384 aa, Homo sapiens
MGPGPSPNWTLDPEPRCRLWSEPRLPAGPGVLAAGSPRLPCRYVMTSEFTLGPTAEFFREHNFFHLDPANVVMFEQRLLPAVTFDGKVILERKDKVAMAPDGNGGLYCALEDHKILEDMERRGVEFVHVYCVDNILVRLADPVFIGFCVLQGADCGAKVVEKAYPEEPVGVVCQVDGVPQVVEYSEISPETAQLRVSDGSLLYNAGNICNHFFTRGFLKAVTREFEPLLKPHVAVKKVPYVDEEGNLVKPLKPNGIKMEKFVFDVFRFAKNFAALEVLREEEFSPLKNAEPADRDSPRTARQALLTQHYRWALRAGARFLDAHGAWLPELPSLPPNGDPPAICEISPLVSYSGEGLEVYLQGREFQSPLILDEDQAREPQLQES

SEQ ID NO: 29383 - protein, 165 aa, Homo sapiens
MAGTALKRLMAEYKQLTLNPPEGIVAGPMNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 29384 - protein, 137 aa, Homo sapiens
MNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 29385 - protein, 422 aa, Homo sapiens
MQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 29386 - protein, 226 aa, Homo sapiens
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKDDSQELPKDPRKCIRPIKTTSFSDYYQTWSRIATSKATEYYRTPLLKVPNFIGQYYKWKKMDLQHQKEWNLK

SEQ ID NO: 29387 - protein, 174 aa, Homo sapiens
MFLTVKLLLGQRCSLKVSGQESVATLKRLVSRRLKVPEEQQHLLFRGQLLEDDKHLSDYCIGPNASINVIMQPLEKMALKEAHQPQTQPLWHQLGLVLAKHFEPQDAKAVLQLLRQEHEERLQKISLEHLEQLAQYLLAEEPHVEPAGERELEAKARPQSSCDMEEKEEAAADQ

SEQ ID NO: 29388 - protein, 352 aa, Homo sapiens
MLLFSVLLLLSLVTGTQLGPRTPLPEAGVAILGRARGAHRPQPRHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKVPMVIMDWEECSKMFPKLTKNMLCAGYKNESYDACKGDSGGPLVCTPEPGEKWYQVGIISWGKSCGEKNTPGIYTSLVNYNLWIEKVTQLEGRPFNAEKRRTSVKQKPMGSPVSGVPEPGSPRSWLLLCPLSHVLFRAILY

SEQ ID NO: 29389 - protein, 152 aa, Homo sapiens
MPSVRSLLRLLAAAAACGAFAFLGYCIYLNRKRRGDPAFKRRLRDKRRAEPQKAEEQGTQLWDPTKNKKLQELFLQEVRMGELWLSRGEHRMGIQHLGNALLVCEQPRELLKVFKHTLPPKVFEMLLHKIPLICQQFEADMNEQDCLEDDPD

SEQ ID NO: 29390 - protein, 5202 aa, Homo sapiens
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDKPGPVVPPILLDVKSRMMLVTWQHPRKSNGVITHYNIYLHGRLYLRTPGNVTNCTVMHLHPYTAYKFQVEACTSKGCSLSPESQTVWTLPGAPEGIPSPELFSDTPTSVIISWQPPTHPNGLVENFTIERRVKGKEEVTTLVTLPRSHSMRFIDKTSALSPWTKYEYRVLMSTLHGGTNSSAWVEVTTRPSRPAGVQPPVVTVLEPDAVQVTWKPPLIQNGDILSYEIHMPDPHITLTNVTSAVLSQKVTHLIPFTNYSVTIVACSGGNGYLGGCTESLPTYVTTHPTVPQNVGPLSVIPLSESYVVISWQPPSKPNGPNLRYELLRRKIQQPLASNPPEDLNRWHNIYSGTQWLYEDKGLSRFTTYEYMLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVRVIWTSPSNPNGVVTEYSIYVNNKLYKTGMNVPGSFILRDLSPFTIYDIQVEVCTIYACVKSNGTQITTVEDTPSDIPTPTIRGITSRSLQIDWVSPRKPNGIILGYDLLWKTWYPCAKTQKLVQDQSDELCKAVRCQKPESICGHICYSSEAKVCCNGVLYNPKPGHRCCEEKYIPFVLNSTGVCCGGRIQEAQPNHQCCSGYYARILPGEVCCPDEQHNRVSVGIGDSCCGRMPYSTSGNQICCAGRLHDGHGQKCCGRQIVSNDLECCGGEEGVVYNRLPGMFCCGQDYVNMSDTICCSASSGESKAHIKKNDPVPVKCCETELIPKSQKCCNGVGYNPLKYVCSDKISTGMMMKETKECRILCPASMEATEHCGRCDFNFTSHICTVIRGSHNSTGKASIEEMCSSAEETIHTGSVNTYSYTDVNLKPYMTYEYRISAWNSYGRGLSKAVRARTKEDVPQGVSPPTWTKIDNLEDTIVLNWRKPIQSNGPIIYYILLRNGIERFRGTSLSFSDKEGIQPFQEYSYQLKACTVAGCATSSKVVAATTQGVPESILPPSITALSAVALHLSWSVPEKSNGVIKEYQIRQVGKGLIHTDTTDRRQHTVTGLQPYTNYSFTLTACTSAGCTSSEPFLGQTLQAAPEGVWVTPRHIIINSTTVELYWSLPEKPNGLVSQYQLSRNGNLLFLGGSEEQNFTDKNLEPNSRYTYKLEVKTGGGSSASDDYIVQTPMSTPEEIYPPYNITVIGPYSIFVAWIPPGILIPEIPVEYNVLLNDGSVTPLAFSVGHHQSTLLENLTPFTQYEIRIQACQNGSCGVSSRMFVKTPEAAPMDLNSPVLKALGSACIEIKWMPPEKPNGIIINYFIYRRPAGIEEESVLFVWSEGALEFMDEGDTLRPFTLYEYRVRACNSKGSVESLWSLTQTLEAPPQDFPAPWAQATSAHSVLLNWTKPESPNGIISHYRVVYQERPDDPTFNSPTVHAFTVKGTSHQAHLYGLEPFTTYRIGVVAANHAGEILSPWTLIQTLESSPSGLRNFIVEQKENGRALLLQWSEPMRTNGVIKTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFIRELFERETKIIHINTTHNSFGMQSYIVNQLKPFHRYEIRIQACTTLGCASSDWTFIQTPEIAPLMQPPPHLEVQMAPGGFQPTVSLLWTGPLQPNGKVLYYELYRRQIATQPRKSNPVLIYNGSSTSFIDSELLPFTEYEYQVWAVNSAGKAPSSWTWCRTGPAPPEGLRAPTFHVISSTQAVVNISAPGKPNGIVSLYRLFSSSAHGAETVLSEGMATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHMGLADTKIPRSGTPVSIRSNRSACVLRIPSQNQTSLTYSQGSLHRSVSQLMDIQDKKVLMDNSLWEAIMGHNSGLYVDEEDLMNAIKDFSSVTKERTTFTDTHL

SEQ ID NO: 29391 - protein, 1055 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 29392 - protein, 712 aa, Homo sapiens
MLAMDTCKHVGQLQLAQDHSSLNPQKWHCVDCNTTESIWACLSCSHVACGRYIEEHALKHFQESSHPVALEVNEMYVFCYLCDDYVLNDNATGDLKLLRRTLSAIKSQNYHCTTRSGRFLRSMGTGDDSYFLHDGAQSLLQSEDQLYTALWHRRRILMGKIFRTWFEQSPIGRKKQEEPFQEKIVVKREVKKRRQELEYQVKAELESMPPRKSLRLQGLAQSTIIEIVSVQVPAQTPASPAKDKVLSTSENEISQKVSDSSVKRRPIVTPGVTGLRNLGNTCYMNSVLQVLSHLLIFRQCFLKLDLNQWLAMTASEKTRSCKHPPVTDTVVYQMNECQEKDTGFVCSRQSSLSSGLSGGASKGRKMELIQPKEPTSQYISLCHELHTLFQVMWSGKWALVSPFAMLHSVWRLIPAFRGYAQQDAQEFLCELLDKIQRELETTGTSLPALIPTSQRKLIKQVLNVVNNIFHGQLLSQVTCLACDNKSNTIEPFWDLSLEFPERYQCSGKDIASQPCLVTEMLAKFTETEALEGKIYVCDQCNSKRRRFSSKPVVLTEAQKQLMICHLPQVLRLHLKRFRWSGRNNREKIGVHVGFEEILNMEPYCCRETLKSLRPECFIYDLSAVVMHHGKGFGSGHYTAYCYNSEGGFWVHCNDSKLSMCTMDEVCKAQAYILFYTQRVTENGHSKLLPPELLLGSQHPNEDADTSSNEILS

SEQ ID NO: 29393 - protein, 139 aa, Homo sapiens [sequence omitted]

SEQ ID NO: 29394 - protein, 334 aa, Homo sapiens
MATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDNTLKLWDYSKGKCLKTYTGHKNEKYCIFANFSVTGGKWIVSGSEDNLVYIWNLQTKEIVQKLQGHTDVVISTACHPTENIIASAALENDKTIKLWKSDC

SEQ ID NO: 29395 - protein, 334 aa, Homo sapiens; identical to SEQ ID NO: 29394

SEQ ID NO: 29396 - protein, 478 aa, Homo sapiens [sequence omitted]

SEQ ID NO: 29397 - protein, 1437 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 29398 - protein, 364 aa, Homo sapiens
MSEVEAAAVATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 29399 - protein, 348 aa, Homo sapiens
MFGPAKGRHFGVHPAPGFPGGVSQQAAGTKAGPAGAWPVGSRTDTMWRLRCKAKDGTHVLQGLSSRTRVRELQGQIAAITGIAPGGQRILVGYPPECLDLSNGDTILEDLPIQSGDMLIIEEDQTRPRSSPAFTKRGASSYVRETLPVLTRTVVPADNSCLFTSVYYVVEGGVLNPACAPEMRRLIAQIVASDPDFYSEAILGKTNQEYCDWIKRDDTWGGAIEISILSKFYQCEICVVDTQTVRIDRFGEDAGYTKRVLLIYDGIHYDPLQRNFPDPDTPPLTIFSSNDDIVLVQALELADEARRRRQFTDVNRFTLRCMVCQKGLTGQAEAREHAKETGHTNFGEV

SEQ ID NO: 29400 - protein, 119 aa, Homo sapiens
MVKMTKSKTFQAYLPNCHRTYSCIHCRAHLANHDELISKSFQGSQGRAYLFNSVVNVGCGPAEERVLLTGLHAVADIYCENCKTTLGWKYEHAFESSQKYKEGKFIIELAHMIKDNGWE

SEQ ID NO: 29401 - protein, 121 aa, Homo sapiens
MGRIFLDHIGGTRLFSCANCDTILTNRSELISTRFTGATGRAFLFNKVVNLQYSEVQDRVMLTGRHMVRDVSCKNCNSKLGWIYEFATEDSQRYKEGRVILERALVRESEGFEEHVPSDNS

SEQ ID NO: 29402 - protein, 1053 aa, Homo sapiens
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTNFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGESKYLCSVCGKSFHRGSGLSKHFKKHQPKPEVRGYHCTQCEKSFFEARDLRQHMNKHLGVKPFQCQFCDKCYSWKKDWYSHVKSHSVTEPYRCNICGKEFYEKALFRRHVKKATHGKKGRAKQNLERVCEKCGRKFTQLREYRRHMNNHEGVKPFECLTCGVAWADARSLKRHVRTHTGERPYVCPVCSEAYIDARTLRKHMTKFHRDYVPCKIMLEKDTLQFHNQGTQVAHAVSILTAGMQEQESSGPQELETVVVTGETMEALEAVAATEEYPSVSTLSDQSIMQVVNYVLAQQQGQKLSEVAEAIQTVKVEVAHISGGE

SEQ ID NO: 29403 - protein, 514 aa, Homo sapiens
MDLANHGLILLQQLNAQREFGFLCDCTVAIGDVYFKAHKSVLASFSNYFKMLFVHQTSECVRLKPTDIQPDIFSYLLHLMYTGKMAPQLIDPVRLEQGIKFLHAYPLIQEASLASQGAFSHPDQVFPLASSLYGIQIADHQLRQATKIASAPEKLGRDPRPQTSRISQEQVPEASQLSQLTSNLAQVNRTNMTPSDPLQTSLSPELVSTPVPPPPPGEETNLEASSSDEQPASLTIAHVKPSIMKRNGSFPKYYACHLCGRRFTLRSSLREHLQIHTGVPFTSSQQGESRVPLTLCSNAADLGKDAMEVPEAGMISDSELQHISDSPIIDGQQQSETPPPSDIADIDNLEQADQEREVKRRKYECTICGRKFIQKSHWREHMYIHTGKPFKCSTCDKSFCRANQAARHVCLNQSIDTYTMVDKQTLELCTFEEGSQMDNMLVQTNKPYKCNLCDKTFSTPNEVVKHSCQNQNSDVFALDEGRSILLGSGDSEVTEPDHPVLASIKKEQETVLLD

SEQ ID NO: 29404 - protein, 487 aa, Homo sapiens
MSLPPIRLPSPYGSDRLVQLAARLRPALCDTLITVGSQEFPAHSLVLAGVSQQLGRRGQWALGEGISPSTFAQLLNFVYGESVELQPGELRPLQEAARALGVQSLEEACWRARGDRAKKPDPGLKKHQEEPEKPSRNPERELGDPGEKQKPEQVSRTGGREQEMLHKHSPPRGRPEMAGATQEAQQEQTRSKEKRLQAPVGQRGADGKHGVLTWLRENPGGSEESLRKLPGPLPPAGSLQTSVTPRPSWAEAPWLVGGQPALWSILLMPPRYGIPFYHSTPTTGAWQEVWREQRIPLSLNAPKGLWSQNQLASSSPTPGSLPQGPAQLSPGEMEESDQGHTGALATCAGHEDKAGCPPRPHPPPAPPARSRPYACSVCGKRFSLKHQMETHYRVHTGEKPFSCSLCPQRSRDFSAMTKHLRTHGAAPYRCSLCGAGCPSLASMQAHMRGHSPSQLPPGWTIRSTFLYSSSRPSRPSTSPCCPSSSTT

SEQ ID NO: 29405 - protein, 494 aa, Homo sapiens
MMTTLQNKEECGKGPKRIFAPPAQKSYSLLPCSPNSPKEETPGISSPETEARISLPKASLKKKEEKATMKNVPSREQEKKRKAQINKQAEKKEKEKSSLTNAEFEEIVQIVLQKSLQECLGMGSGLDFAETSCAQPVVSTQSDKEPGITASATDTDNANGEEVPHTQEISVSWEGEAAPEIRTSKLGQPDPAPSKKKSNRLTLSKRKKEAHEKVEKTQGGHEHRQEDRLKKTVQDHSQIRDQQKGEISGFGQCLVWVQCSFPNCGKWRRLCGNIDPSVLPDNWSCDQNTDVQYNRCDIPEETWTGLESDVAYASYIPGSIIWAKQYGYPWWPGMIESDPDLGEYFLFTSHLDSLPSKYHVTFFGETVSRAWIPVNMLKNFQELSLELSVMKKRRNDCSQKLGVALMMAQEAEQISIQERVNLFGFWSRFNGSNSNGERKDLQLSGLNSPGSCLEKKEKEEELEKEEGEKTDPILPIRKRVKIQTQKNQAKRAWG

SEQ ID NO: 29406 - protein, 440 aa, Homo sapiens
MGDLELLLPGEAEVLVRGLRSFPLREMGSEGWNQQHENLEKLNMQAILDATVSQGEPIQELLVTHGKVPTLVEELIAVEMWKQKVFPVFCRVEDFKPQNTFPIYMVVHHEASIINLLETVFFHKEVCESAEDTVLDLVDYCHRKLTLLVAQSGCGGPPEGEGSQDSNPMQELQKQAELMEFEIALKALSVLRYITDCVDSLSLSTLSRMLSTHNLPCLLVELLEHSPWSRREGGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 29407 - protein, 2099 aa, Homo sapiens
MDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFCIKSPKPAESPQSATKQLDQPTAAYEYYDAGNHWCKDCNTICGTMFDFFTHMHNKKHTQTLDPYNRPWASKTQSEAKQDAIKRTDKITVPAKGSEFLVPISGFYCQLCEEFLGDPISGEQHVKGHQHNEKYKKYVDENPLYEERRNLDRQAGLAVVLETERRRQSELKRKLSEKPKEEKKEKKAKAVKEVKEDDKVSEKLEDQLSEGRNSPEKAENKRNTGIKLQFKEEVKKESPTSSSFGKFSWKKPEKEEEKSSLVTPSISKEEILESSKDKEDGKTEAGKAKPIKIKLSGKTVVAHTSPWMPVVTTSTQTKIGPNLPIPSTVLRKSCSATMSKPAPLNTFLSIKSSGTTAKPLPVVKESSADLLLPPDIISKAFGGEEVILKGSPEEKVVLAEKSEPSHLPEQILPPPPPPPPPPPPPPPVIPHPAAPSAAQANAILAPVKSNPVVSQTLSPGFVGPNILNPVLPVAIMASAQPAAIPSDETAPGVSESDRDQTLFSVLVRPPPPLSSVFSEQAKKLEKRNSCLATANAKDLYDIFYSSGGKGAPETKGAPETKLSGGPLANGENSNLSRTKSSDTSSTSPLNSSASQEELHQDEGLVAAPIVSNSEKPIAKTLVALGKWSVVEHVGPKSTGSTYGFLQPLTRLCQSRPYETITPKTDTLAIWTSSSFQSDTSRDISPEKSELDLGEPGPPGVEPPPQLLDIQCKESQKLVEIHLRESVNQDKESQELRKSEDCRESEIETNTELKERVKELSEGIVDEGASTSIGPHSIDDSNLNHGNRYMWEGEVKQPNLLMIDKEAEQSNKLMTGSETPSKVVIKLSPQACSFTKAKLDSFLSEARSLLNPQDTPVKISAPELLLHSPARSAMCLTGSPQEQGVSVVSEEGLENSAPESASRTSRYRSLKLKRERSKDFQVKKIYELAVWDENKKRPETWESPEKPKTEALELQDVHPELTVTIESKALEDFEATDLKVEELTALGNLGDMPVDFCTTRVSPAHRSPTVLCQKVCEENSVSPIGCNSSDPADFEPIPSFSGFPLDSPKTLVLDFETEGERNSPNPRSVRIPSPNILKTGLTENVDRGLGGLEGTHQALDLLAGGMMPEEVKESSQLDKQESLGLELKTINFAGLGPSPCLPDLVDFVTRTSGVQKDKLCSPLSEPGDPSKCSSLELGPLQLEISNASTTEVAILQVDDDSGDPLNLVKAPVSRSPPREQVIEDNMVPQGMPEQETTVGAIQDHTESSVHN

SEQ ID NO: 29408 - protein, 711 aa, Homo sapiens
MESGAVLLESKSSPFNLLHEMHELRLLGHLCDVTVSVEYQGVRKDFMAHKAVLAATSKFFKEVFLNEKSVDGTRTNVYLNEVQVADFASFLEFVYTAKVQVEEDRVQRMLEVAEKLKCLDLSETCFQLKKQMLESVLLELQNFSESQEVEVSSGSQVSAAPAPRASVATDGPHPSGLTDSLDYPGERASNGMSSDLPPKKSKDKLDKKKEVVKPPYPKIRRASGRLAGRKVFVEIPKKKYTRRLREQQKTAEGDVGDYRCPQDQSPDRVGTEMEQVSKNEGCQAGAELEELSKKAGPEEEEEEEEEDEEGEKKKSNFKCSICEKAFLYEKSFLKHSKHRHGVATEVVYRCDTCGQTFANRCNLKSHQRHVHSSERHFPCELCGKKFKRKKDVKRHVLQVHEGGGERHRCGQCGKGLSSKTALRLHERTHTGDRPYGCTECGARFSQPSALKTHMRIHTGEKPFVCDECGARFTQNHMLIYHKRCHTGERPFMCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 29409 - protein, 473 aa, Homo sapiens
MMTKVLGMAPVLGPRPPQEQVGPLMVKVEEKEEKGKYLPSLEMFRQRFRQFGYHDTPGPREALSQLRVLCCEWLRPEIHTKEQILELLVLEQFLTILPQELQAWVQEHCPESAEEAVTLLEDLERELDEPGHQVSTPPNEQKPVWEKISSSGTAKESPSSMQPQPLETSHKYESWGPLYIQESGEEQEFAQDPRKVRDCRLSTQHEESADEQKGSEAEGLKGDIISVIIANKPEASLERQCVNLENEKGTKPPLQEAGSKKGRESVPTKPTPGERRYICAECGKAFSNSSNLTKHRRTHTGEKPYVCTKCGKAFSHSSNLTLHYRTHLVDRPYDCKCGKAFGQSSDLLKHQRMHTEEAPYQCKDCGKAFSGKGSLIRHYRIHTGEKPYQCNECGKSFSQHAGLSSHQRLHTGEKPYKCKECGKAFNHSSNFNKHHRIHTGEKPYWCHHCGKTFCSKSNLSKHQRVHTGEGEAP

SEQ ID NO: 29410 - protein, 241 aa, Homo sapiens
MTHLTQHQTTHTREKFHECSECGKAFSRVSALIDHQRIHSGEKPYECKECGRAFTQSAQLIRHQKTHSGEKPYECSKCKKSFVHLSSLIEHWRIHTGEKPYQCKDCKKTFCRVMQFTLHRRIHTGEKPYECKEFGKSFSAHSSLVTHKRTHSGEKPYKCKECGKAFSAHSSLVTHKRTHSGEKPYTCHACGKAFNTSSTLCQHNRIHTGEKPFQCSQCGKSFSCSSHLTRHCRMCNGKFSK

SEQ ID NO: 29411 - protein, 790 aa, Homo sapiens
MAYCLTNCYQYSVTFEDTAVDFTQEEWILLDPVQRNLYRDVMLENYENVAKVGFQLFKPSVISWLEEEELRTLQQGVLQDWAIKHQTSVSALQQEFWKIQTSNGIQMDLVTFDSVAVEFTQEEWTLLDPAQRNLYSDVMLENYKNLSSVGYQLFKPSLISWLEEEEELSTLPRVLQEWKMCLKTKGPALWQDNFCLKTLNGIQLARNQNGEELYDCKQCEDVFCKHPCLKTNMSTQNRGNTSECIQYAKDLLSLYNKTSTIRKVSVFSKHGKSFRLILNVQVQRKCTQDKSFEGTDYGKAFIYQSYLEAHRKTQSGEKLNEWKQCGEAFTHSTSHAVNVETHIIKNPYECKECGKDFRYPTHLNNHMQTHIGIKPYKCKHCGKTFTVPSGFLEHVRTHTGEKPYGCKECGKAFGTSAGLIEHIRCHAREKTFKCDHCGKAFISYPSLFGHLRVHNGEKPYEHKEYGKAFGTSSGIIEDRRSNTGQKRFDCDQCGKVFVSFSSLFAHLRTHTGEKPFKCYKCGKPFTSSACLRIHMRTHTEERLYQCKKCGKAFTKCSYLTKHLRTHAGEKPYECMKCGKAFTERSYLTKHLRRHSGEKPYECKKCGKAFTERSDLTKHLRRHTGDKPYEYKDCGKAFVVSSSLVDHLRTHTGYKPYKCNACEKAYSRSCVLTQHLKTHAAEKTSECNACGNSFRNSMCFHDRLKTLTKIKPYKCKDCGKAFTCHSDLTNHVRIHTGEKPYKCKECGKAFRTSSGRIQHLRTHMGEKPFECDQCGKAFASFSARIAHLKTH

SEQ ID NO: 29412 - protein, 696 aa, Homo sapiens
MAYGSITFGDVAIDFSHQEWEYLSLVQKTLYQEVMMENYDNLVSLAGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKRPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 29413 - protein, 425 aa, Homo sapiens
MNKMPAGEQECEYNKEGKYYSKGVKLVRKKKKIPGYRWGDIKINIIGEKDDLPIHFCDKCDLPIKIYGRIIPCKHAFCYHCANLYDKVGYKVCPRCRYPVLRIEAHKRGSVFMCSIVQQCKRTYLSQKSLQAHIKRRHKRARKQVTSASLEKVRPHIAPPQTEISDIPKRLQDRDHLSYIPPEQHTMVSLPSVQHMLQEQHNQPHKDIQAPPPELSLSLPFPIQWETVSIFTRKHGNLTVDHIQNNSDSGAKKPTPPDYYPECQSQPAVSSPHHIIPQKQHYAPPPSPSSPVNHQMPYPPQDVVTPNSVRSQVPALTTTYDPSSGYIIVKVPPDMNSPPLRAPQSQNGNPSASEFASHHYNLNILPQFTENQETLSPQFTQTDAMDHRRWPAWKRLSPCPPTRSPPPSTLHGRSHHSHQRRHRRY

SEQ ID NO: 29414 - protein, 46 aa, Homo sapiens
MEEIPAQEAAGSPRVQFQSLETQSECLSPEPQFVQDTDMEQGLTGG

SEQ ID NO: 29415 - protein, 76 aa, Homo sapiens
MEEIPAQEAAGSPRVQFQSLETQSECLSPEPQFVQDTDMEQGLTGAPPVPQVPALPREGSPGDQAAALLTARYQVS

SEQ ID NO: 29416 - protein, 110 aa, Homo sapiens
MEEIPAQEAAGSPRVQFQSLETQSECLSPEPQFVQDTDMEQGLTGGILLRLPTTRIHSVNSCPALSHTQASAFSGETLAVLTAGISKRWPKYRLPIDIARPCSETPFPRL

SEQ ID NO: 29417 - protein, 491 aa, Homo sapiens
MEEIPAQEAAGSPRVQFQSLETQSECLSPEPQFVQDTDMEQGLTGDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 29418 - protein, 181 aa, Homo sapiens
MEEIPAQEAAGSPRVQFQSLETQSECLSPEPQFVQDTDMEQGLTGAPPVPQVPALPREGSPGDQAAALLTARYQEFVTFEDVAVHLTREEWGYLDPVQRDLYREVMLENYGNVVSLGILLRLPTTRIHSVNSCPALSHTQASAFSGETLAVLTAGISKRWPKYRLPIDIARPCSETPFPRL

SEQ ID NO: 29419 - protein, 491 aa, Homo sapiens; identical to SEQ ID NO: 29417

SEQ ID NO: 29420 - protein, 584 aa, Homo sapiens
MALSQGLFTFKDVAIEFSQEEWECLDPAQRALYRDVMLENYRNLLSLDEDNIPPEDDISVGFTSKGLSPKENNKEELYHLVILERKESHGINNFDLKEVWENMPKFDSLWDYDVKNYKGMPLTCNKNLTHRKDQQHNKSSIHFSLKQSVSIRDSAHQYFIHDKPFIRNLLKLKNNIRYAGNKYVKCFENKIGLSLQAQLAELQRFQTGEKMYECNPVEKSINSSSVSPLPPCVKNICNKYRKILKYPLLHTQYGRTHIREKSYKCNDCGKAFSKSSNLTNHQRIHSGQRPYKCNECGKAFNQCSNLTRHQRVHTGEKPYQCNICGKVCSQNSNLASHQRMHTGEKPYKCNECGKAFIQRSHLWGHERIHTGEKPYKCNECDKAFAERSSLTQHKRIHTGEKPYICNECGKAFKQCSHLTRHQNIHPGEKPHKCNVCGRAFIQSSSLVEHQRIHTGEKPYKCNKCDKAFIKRSHLWGHQRTHTGEKPYKCTECGKAFTERSNLTQHKKIHTGEKPYKCTECGKAFTQFANLTRHQKIHIEKKHCKHNIHGNALFQSSNLGDHQKSYNREKHIKYNETKIKYSSCT

SEQ ID NO: 29421 - protein, 509 aa, Homo sapiens
MALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPNLFTYGALPSDQCPHLLMLPQDPSYPTMAMPSLLMMVNELGHPSARWETLLPYPGAFQASGQALPSQARNPGAGAAPTDSPGLERGGMASPAKRVPLSSQTGTAALPYPLKKKNGKILYECNICGKSFGQLSNLKVHLRVHSGERPFQCALCQKSFTQLAHLQKHHLVHTGERPHKCSIPWVPGRNHWKSFQAWREREVCHKRFSSSSNLKTHLRLHSGARPFQCSVCRSRFTQHIHLKLHHRLHAPQPCGLVHTQLPLASLACLAQWHQGALDLMAVASEKHMGYDIDEVKVSSTSQGKARAVSLSSAGTPLVMGQDQNN

SEQ ID NO: 29422 - protein, 429 aa, Homo sapiens
MPLCRPEHLMPRASRVPVAASLPLSHAVIPTQLPSRSGHRPPGRPRRCPKASCLPPPVGPSSTQTAKRVTMGWPRPGQALVAVKALLVLSLLQVPAQAVVRAVLEDNSSSVDFADLPALFGVPLAPEGIRGYLMEVKPANACHPIEAPRLGNRSLGSIALIRHYDCTFDLKVLNAQRAGFEAAIVHNVHSDDLVSMTHVYEDLRGQIAIPSVFVSEAASQDLRVILGCNKSAHALLLPDDPPCHDLGCHPVLTVSWVLGCTLALVVSAFFVLNHLWLWAQACCSHRRPVKTSTCQKAQVRTFTWHNDLCAICLDEYEEGDQLKILPCSHTYHCKCIDPWFSQAPRRSCPVCKQSVAATEDSFDSTTYSFRDEDPSLPGHRPPIWAIQVQLRSRRLELLGRASPHCHCSTTSLEAEYTTVSSAPPEAPGQ

SEQ ID NO: 29423 - protein, 351 aa, Homo sapiens
MEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSVENRTAQITSTGSLVFQNFEESMSGIYTCFLEYKPTVEEIVKRLQLKYAIYAYREPHYYYQFTARYHAVPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 29424 - protein, 316 aa, Homo sapiens
MMRTCVLLSAVLWCLTGDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 29425 - protein, 338 aa, Homo sapiens
MMRTCVLLSAVLWCLTGVQCPRFTLFNKKGFIYGKTGQPDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 29426 - protein, 591 aa, Homo sapiens
MWERLNCAAEDFYSRLLQKFNEEKKGIRKDPFLYEADVQVQLISKGQPNPLKNILNENDIVFIVEKVPLEKEETSHIEELQSEETAISDFSTGENVGPLALPVGKARQLIGLYTMAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYRGQKKIKTVWQLSDSSPIDHLNFHKPDFSELTLNGSLEERIFFTNMVTCSQVHFK

SEQ ID NO: 29427 - DNA, 17 bp, Homo sapiens
gatctgacctcacacca

SEQ ID NO: 29428 - DNA, 17 bp, Homo sapiens
gatctctttgacagata

SEQ ID NO: 29429 - DNA, 17 bp, Homo sapiens
gatctgacctggttctc

SEQ ID NO: 29430 - DNA, 17 bp, Homo sapiens
gatcaagctgggtttgg

SEQ ID NO: 29431 - DNA, 17 bp, Homo sapiens
gatctatctggacagac

SEQ ID NO: 29432 - DNA, 17 bp, Homo sapiens
gatcttgttttatatct

SEQ ID NO: 29433 - DNA, 17 bp, Homo sapiens
gatctatggcctggtgg

SEQ ID NO: 29434 - DNA, 17 bp, Homo sapiens
gatcttcccttacatta

SEQ ID NO: 29435 - DNA, 17 bp, Homo sapiens
gatcagcaaataaacag

SEQ ID NO: 29436 - DNA, 17 bp, Homo sapiens
gatcttccaaagttgta

SEQ ID NO: 29437 - DNA, 17 bp, Homo sapiens
gatcccggttaggtctt

SEQ ID NO: 29438 - DNA, 17 bp, Homo sapiens
gatcatgtcagttggcc

SEQ ID NO: 29439 - DNA, 17 bp, Homo sapiens
gatcttaagtggtttga

SEQ ID NO: 29440 - DNA, 17 bp, Homo sapiens
gatcgtgtctgccctgc

SEQ ID NO: 29441 - DNA, 17 bp, Homo sapiens
gatcccaaatgcaggaa

SEQ ID NO: 29442 - DNA, 17 bp, Homo sapiens
gatccttgactcctctt

SEQ ID NO: 29443 - DNA, 17 bp, Homo sapiens
gatctgaaggtacctga

SEQ ID NO: 29444 - DNA, 17 bp, Homo sapiens
gatctgatgaaccaccc

SEQ ID NO: 29445 - DNA, 17 bp, Homo sapiens
gatcaaggcttttagga

SEQ ID NO: 29446 - DNA, 17 bp, Homo sapiens
gatcctgacggaagaga

SEQ ID NO: 29447 - DNA, 17 bp, Homo sapiens
gatctggccctagggag

SEQ ID NO: 29448 - DNA, 17 bp, Homo sapiens
gatcgtagcacttgggg

SEQ ID NO: 29449 - DNA, 17 bp, Homo sapiens
gatcatttaaaagaaag

SEQ ID NO: 29450 - DNA, 17 bp, Homo sapiens
gatctgcgtccattcaa

SEQ ID NO: 29451 - DNA, 17 bp, Homo sapiens
gatcttactgtgctgag

SEQ ID NO: 29452 - DNA, 17 bp, Homo sapiens
gatcaggaagagggaac

SEQ ID NO: 29453 - DNA, 17 bp, Homo sapiens
gatcttcttcatgccag

SEQ ID NO: 29454 - DNA, 17 bp, Homo sapiens
gatccctcccaccagct

SEQ ID NO: 29455 - DNA, 17 bp, Homo sapiens
gatccaagcctggagac

SEQ ID NO: 29456 - DNA, 17 bp, Homo sapiens
gatctagcacattaccc

SEQ ID NO: 29457 - DNA, 17 bp, Homo sapiens
gatcctacattttggta

SEQ ID NO: 29458 - DNA, 17 bp, Homo sapiens
gatcaaccaaaactgag

SEQ ID NO: 29459 - DNA, 17 bp, Homo sapiens
gatcattctggatgtca

SEQ ID NO: 29460 - DNA, 17 bp, Homo sapiens
gatccagacctaaaaaa

SEQ ID NO: 29461 - DNA, 17 bp, Homo sapiens
gatctttacagattcat

SEQ ID NO: 29462 - DNA, 17 bp, Homo sapiens
gatcactgctgcagaat

SEQ ID NO: 29463 - DNA, 17 bp, Homo sapiens
gatcccatctgagttgg

SEQ ID NO: 29464 - DNA, 17 bp, Homo sapiens
gatccatgtgaactatt

SEQ ID NO: 29465 - DNA, 17 bp, Homo sapiens
gatcacatttttagttc

SEQ ID NO: 29466 - DNA, 17 bp, Homo sapiens
gatcgtatctaaatcac

SEQ ID NO: 29467 - DNA, 17 bp, Homo sapiens
gatcagaggcctctgtg

SEQ ID NO: 29468 - DNA, 17 bp, Homo sapiens
gatctcatttttcctcc

SEQ ID NO: 29469 - DNA, 17 bp, Homo sapiens
gatcctggaggagacac

SEQ ID NO: 29470 - DNA, 17 bp, Homo sapiens
gatcgtgacaagttttt

SEQ ID NO: 29471 - DNA, 17 bp, Homo sapiens
gatctttccattgatga

SEQ ID NO: 29472 - DNA, 17 bp, Homo sapiens
gatcctgaagcacccct

SEQ ID NO: 29473 - DNA, 17 bp, Homo sapiens
gatccctttattgacag

SEQ ID NO: 29474 - DNA, 17 bp, Homo sapiens
gatctgactgagcgaca

SEQ ID NO: 29475 - DNA, 17 bp, Homo sapiens
gatctcagatttctgtc

SEQ ID NO: 29476 - DNA, 17 bp, Homo sapiens
gatcgctgacctggatg

SEQ ID NO: 29477 - DNA, 17 bp, Homo sapiens
gatctcacttttgatac

SEQ ID NO: 29478 - DNA, 17 bp, Homo sapiens
gatctgtaaatattgct

SEQ ID NO: 29479 - DNA, 17 bp, Homo sapiens
gatcgtgaacctgtatt

SEQ ID NO: 29480 - DNA, 17 bp, Homo sapiens
gatcccgtcttaaaaaa

SEQ ID NO: 29481 - DNA, 17 bp, Homo sapiens
gatcttcgtcttgttgt

SEQ ID NO: 29482 - DNA, 17 bp, Homo sapiens
gatcaaaacctttttga

SEQ ID NO: 29483 - DNA, 17 bp, Homo sapiens
gatcacctcaatgtggg

SEQ ID NO: 29484 - DNA, 17 bp, Homo sapiens
gatcagtattcttgcct

SEQ ID NO: 29485 - DNA, 17 bp, Homo sapiens
gatccagcttcaacgaa

SEQ ID NO: 29486 - DNA, 17 bp, Homo sapiens
gatcagatagatagata

SEQ ID NO: 29487 - DNA, 17 bp, Homo sapiens
gatcatcatgtatacca

SEQ ID NO: 29488 - DNA, 17 bp, Homo sapiens
gatcttttctaagcctt

SEQ ID NO: 29489 - DNA, 17 bp, Homo sapiens
gatcaaaatgcatatgg

SEQ ID NO: 29490 - DNA, 17 bp, Homo sapiens
gatcccgattgaacctg

SEQ ID NO: 29491 - DNA, 17 bp, Homo sapiens
gatcctgaagatacaga

SEQ ID NO: 29492 - DNA, 17 bp, Homo sapiens
gatccttacgttgattt

SEQ ID NO: 29493 - DNA, 17 bp, Homo sapiens
gatcagcccttgatggc

SEQ ID NO: 29494 - DNA, 17 bp, Homo sapiens
gatcctgaaaaatacca

SEQ ID NO: 29495 - DNA, 17 bp, Homo sapiens
gatcatggtggaggtga

SEQ ID NO: 29496 - DNA, 17 bp, Homo sapiens
gatctggtcaagaccta

SEQ ID NO: 29497 - DNA, 17 bp, Homo sapiens
gatccaaacccacaggc

SEQ ID NO: 29498 - DNA, 17 bp, Homo sapiens
gatccagcaccactatt

SEQ ID NO: 29499 - DNA, 17 bp, Homo sapiens
gatctacaggaccagtt

SEQ ID NO: 29500 - DNA, 17 bp, Homo sapiens
gatctgtgacttcttgg

SEQ ID NO: 29501 - DNA, 17 bp, Homo sapiens
gatcaagcctttttgtt

SEQ ID NO: 29502 - DNA, 17 bp, Homo sapiens
gatccatcaggtagatg

SEQ ID NO: 29503 - DNA, 17 bp, Homo sapiens
gatcccagttgcatagt

SEQ ID NO: 29504 - DNA, 17 bp, Homo sapiens
gatcttctgagtccctg

SEQ ID NO: 29505 - DNA, 17 bp, Homo sapiens
gatctcagacttctgtc

SEQ ID NO: 29506 - DNA, 17 bp, Homo sapiens
gatctggcataggggta

SEQ ID NO: 29507 - DNA, 17 bp, Homo sapiens
gatcagctgtatctttt

SEQ ID NO: 29508 - DNA, 17 bp, Homo sapiens
gatcattttgttagatg

SEQ ID NO: 29509 - DNA, 17 bp, Homo sapiens
gatcatttacagactcc

SEQ ID NO: 29510 - DNA, 17 bp, Homo sapiens
gatctgcctgcagagct

SEQ ID NO: 29511 - DNA, 17 bp, Homo sapiens
gatctcagtcacaacca

SEQ ID NO: 29512 - DNA, 17 bp, Homo sapiens
gatccagaggaagttgc

SEQ ID NO: 29513 - DNA, 17 bp, Homo sapiens
gatcttccagaaaatga

SEQ ID NO: 29514 - DNA, 17 bp, Homo sapiens
gatccttccctgtccct

SEQ ID NO: 29515 - DNA, 17 bp, Homo sapiens
gatcatcatcacgcgag

SEQ ID NO: 29516 - DNA, 17 bp, Homo sapiens
gatcaaagacatcagtg

SEQ ID NO: 29517 - DNA, 17 bp, Homo sapiens
gatcccaggaccatgtc

SEQ ID NO: 29518 - DNA, 17 bp, Homo sapiens
gatcaggtgcaacacca

SEQ ID NO: 29519 - DNA, 17 bp, Homo sapiens
gatccacagacctgtta

SEQ ID NO: 29520 - DNA, 17 bp, Homo sapiens
gatctcttcttcagatt

SEQ ID NO: 29521 - DNA, 17 bp, Homo sapiens
gatccaaaagaagagat

SEQ ID NO: 29522 - DNA, 17 bp, Homo sapiens
gatccggtggaagataa

SEQ ID NO: 29523 - DNA, 17 bp, Homo sapiens
gatccggcagacactcc

SEQ ID NO: 29524 - DNA, 17 bp, Homo sapiens
gatcagattatgcgacg

SEQ ID NO: 29525 - DNA, 17 bp, Homo sapiens
gatccatctgcagcaga

SEQ ID NO: 29526 - DNA, 17 bp, Homo sapiens
gatcatgcaggcactgg

SEQ ID NO: 29527 - DNA, 17 bp, Homo sapiens
gatcacaagcccaagga

SEQ ID NO: 29528 - DNA, 17 bp, Homo sapiens
gatcagtccaccctgaa

SEQ ID NO: 29529 - DNA, 17 bp, Homo sapiens
gatccaaagagttcaga

SEQ ID NO: 29530 - DNA, 17 bp, Homo sapiens
gatcacagttggcttta

SEQ ID NO: 29531 - DNA, 17 bp, Homo sapiens
gatccccttcatcactg

SEQ ID NO: 29532 - DNA, 17 bp, Homo sapiens
gatcttcccccaaaatg

SEQ ID NO: 29533 - DNA, 17 bp, Homo sapiens
gatcagatggtactaga

SEQ ID NO: 29534 - DNA, 17 bp, Homo sapiens
gatcagaccggaacagg

SEQ ID NO: 29535 - DNA, 17 bp, Homo sapiens
gatcccattaccccacc

SEQ ID NO: 29536 - DNA, 17 bp, Homo sapiens
gatcctatgtttccttc

SEQ ID NO: 29537 - DNA, 17 bp, Homo sapiens
gatctgtgaaatatggg

SEQ ID NO: 29538 - DNA, 17 bp, Homo sapiens
gatcacgcacttgaact

SEQ ID NO: 29539 - DNA, 17 bp, Homo sapiens
gatccaggccgtctgta

SEQ ID NO: 29540 - DNA, 17 bp, Homo sapiens
gatcagtctggtactga

SEQ ID NO: 29541 - DNA, 17 bp, Homo sapiens
gatcaatcttttacaac

SEQ ID NO: 29542 - DNA, 17 bp, Homo sapiens
gatcattgtggttggtg

SEQ ID NO: 29543 - DNA, 17 bp, Homo sapiens
gatctctcctgggttca

SEQ ID NO: 29544 - DNA, 17 bp, Homo sapiens
gatcagaaggaaagtcc

SEQ ID NO: 29545 - DNA, 17 bp, Homo sapiens
gatccttgtcatccctt

SEQ ID NO: 29546 - DNA, 17 bp, Homo sapiens
gatctgaagaatggttc

SEQ ID NO: 29547 - DNA, 17 bp, Homo sapiens
gatcaggctatgtcttg

SEQ ID NO: 29548 - DNA, 17 bp, Homo sapiens
gatcataaagaaaaatc

SEQ ID NO: 29549 - DNA, 17 bp, Homo sapiens
gatcattttgaatagtt

SEQ ID NO: 29550 - DNA, 17 bp, Homo sapiens
gatcacatcaaaagcat

SEQ ID NO: 29551 - DNA, 17 bp, Homo sapiens
gatctcaataaacctct

SEQ ID NO: 29552 - DNA, 17 bp, Homo sapiens
gatcaggaagatggagt

SEQ ID NO: 29553 - DNA, 17 bp, Homo sapiens
gatcagccttcatggcc

SEQ ID NO: 29554 - DNA, 17 bp, Homo sapiens
gatccccatttactcac

SEQ ID NO: 29555 - DNA, 17 bp, Homo sapiens
gatccttaccaagtttc

SEQ ID NO: 29556 - DNA, 17 bp, Homo sapiens
gatccgtcgcctgtttc

SEQ ID NO: 29557 - DNA, 17 bp, Homo sapiens
gatccttcttaccaaat

SEQ ID NO: 29558 - DNA, 17 bp, Homo sapiens
gatcagcaaaaccagtg

SEQ ID NO: 29559 - DNA, 17 bp, Homo sapiens
gatcgtgttccagtgct

SEQ ID NO: 29560 - DNA, 17 bp, Homo sapiens
gatccaaataaaaaaga

SEQ ID NO: 29561 - DNA, 17 bp, Homo sapiens
gatccctatatgcgggg

SEQ ID NO: 29562 - DNA, 17 bp, Homo sapiens
gatcatttcagcagtgt

SEQ ID NO: 29563 - DNA, 17 bp, Homo sapiens
gatcttgaagactccat

SEQ ID NO: 29564 - DNA, 17 bp, Homo sapiens
gatccagagaatggaat

SEQ ID NO: 29565 - DNA, 17 bp, Homo sapiens
gatccaggcctgcaagg

SEQ ID NO: 29566 - DNA, 17 bp, Homo sapiens
gatccatatgaattcct

SEQ ID NO: 29567 - DNA, 17 bp, Homo sapiens
gatcagtcttctcgccg

SEQ ID NO: 29568 - DNA, 17 bp, Homo sapiens
gatcactggaatggaat

SEQ ID NO: 29569 - DNA, 17 bp, Homo sapiens
gatcaccatcactgtat

SEQ ID NO: 29570 - DNA, 17 bp, Homo sapiens
gatccaaagctggaaga

SEQ ID NO: 29571 - DNA, 17 bp, Homo sapiens
gatctgtaagaagctgt

SEQ ID NO: 29572 - DNA, 17 bp, Homo sapiens
gatccaaatattaccga

SEQ ID NO: 29573 - DNA, 17 bp, Homo sapiens
gatcagctttgcacatg

SEQ ID NO: 29574 - DNA, 17 bp, Homo sapiens
gatctggaatggagata

SEQ ID NO: 29575 - DNA, 17 bp, Homo sapiens
gatctggagccgtgtgt

SEQ ID NO: 29576 - DNA, 17 bp, Homo sapiens
gatcccagaagaaacag

SEQ ID NO: 29577 - DNA, 17 bp, Homo sapiens
gatctcctttaactttt

SEQ ID NO: 29578 - DNA, 17 bp, Homo sapiens
gatcgcccactccgaga

SEQ ID NO: 29579 - DNA, 17 bp, Homo sapiens
gatccagaaatgacgct

SEQ ID NO: 29580 - DNA, 17 bp, Homo sapiens
gatcaaaaagcttagaa

SEQ ID NO: 29581 - DNA, 17 bp, Homo sapiens
gatccccattggatata

SEQ ID NO: 29582 - DNA, 17 bp, Homo sapiens
gatcaacacttccagga

SEQ ID NO: 29583 - DNA, 17 bp, Homo sapiens
gatcggaagcgtgaaat

SEQ ID NO: 29584 - DNA, 17 bp, Homo sapiens
gatcagagtggaagttc

SEQ ID NO: 29585 - DNA, 17 bp, Homo sapiens
gatcttctcctaaaaga

SEQ ID NO: 29586 - DNA, 17 bp, Homo sapiens
gatcaaatgaaagtcta

SEQ ID NO: 29587 - DNA, 17 bp, Homo sapiens
gatcaattcttcagact

SEQ ID NO: 29588 - DNA, 17 bp, Homo sapiens
gatcgtgcatgtgctga

SEQ ID NO: 29589 - DNA, 17 bp, Homo sapiens
gatctacagtatttttt

SEQ ID NO: 29590 - DNA, 17 bp, Homo sapiens
gatcacaaatttattaa

SEQ ID NO: 29591 - DNA, 17 bp, Homo sapiens
gatcaccagcatcaagg

SEQ ID NO: 29592 - DNA, 17 bp, Homo sapiens
gatcgcttgaaagctga

SEQ ID NO: 29593 - DNA, 17 bp, Homo sapiens
gatcaaaatcaacatac

SEQ ID NO: 29594 - DNA, 17 bp, Homo sapiens
gatcaaatgtgaaagta

SEQ ID NO: 29595 - DNA, 17 bp, Homo sapiens
gatctccaagaagaggc

SEQ ID NO: 29596 - DNA, 17 bp, Homo sapiens
gatcaggagcggaataa

SEQ ID NO: 29597 - DNA, 17 bp, Homo sapiens
gatctgtgattcaataa

SEQ ID NO: 29598 - DNA, 17 bp, Homo sapiens
gatcgtgaaagaagaag

SEQ ID NO: 29599 - DNA, 17 bp, Homo sapiens
gatcatagcagaacttc

SEQ ID NO: 29600 - DNA, 17 bp, Homo sapiens
gatcaattcttctctca

SEQ ID NO: 29601 - DNA, 17 bp, Homo sapiens
gatcaagctaacttttg

SEQ ID NO: 29602 - DNA, 17 bp, Homo sapiens
gatcaacttcagtccat

SEQ ID NO: 29603 - DNA, 17 bp, Homo sapiens
gatccaggaagaaagta

SEQ ID NO: 29604 - DNA, 17 bp, Homo sapiens
gatcactatagcaactg

SEQ ID NO: 29605 - DNA, 17 bp, Homo sapiens
gatcaaactcttttaca

SEQ ID NO: 29606 - DNA, 17 bp, Homo sapiens
gatcaagttttgttaga

SEQ ID NO: 29607 - DNA, 17 bp, Homo sapiens
gatcactgcccaaagcg

SEQ ID NO: 29608 - DNA, 17 bp, Homo sapiens
gatccaataaagtcctg

SEQ ID NO: 29609 - DNA, 17 bp, Homo sapiens
gatcaactaatgttgtt

SEQ ID NO: 29610 - DNA, 17 bp, Homo sapiens
gatccattttccttaga

SEQ ID NO: 29611 - DNA, 17 bp, Homo sapiens
gatctaattcacagaac

SEQ ID NO: 29612 - DNA, 17 bp, Homo sapiens
gatcctgactcagtgca

SEQ ID NO: 29613 - DNA, 17 bp, Homo sapiens
gatcttcatttaatgtt

SEQ ID NO: 29614 - DNA, 17 bp, Homo sapiens
gatcactctcatcaatg

SEQ ID NO: 29615 - DNA, 17 bp, Homo sapiens
gatcatttccttctgaa

SEQ ID NO: 29616 - DNA, 17 bp, Homo sapiens
gatctgtatcaagataa

SEQ ID NO: 29617 - DNA, 17 bp, Homo sapiens
gatcctgtgctgtcctt

SEQ ID NO: 29618 - DNA, 17 bp, Homo sapiens
gatcatctttgcccgca

SEQ ID NO: 29619 - DNA, 17 bp, Homo sapiens
gatctgctgtaaaagat

SEQ ID NO: 29620 - DNA, 17 bp, Homo sapiens
gatctctctttcttttt

SEQ ID NO: 29621 - DNA, 17 bp, Homo sapiens
gatctacatattgagga

SEQ ID NO: 29622 - DNA, 17 bp, Homo sapiens
gatctcaactgaaagat

SEQ ID NO: 29623 - DNA, 17 bp, Homo sapiens
gatcctgatggaacttt

SEQ ID NO: 29624 - DNA, 17 bp, Homo sapiens
gatctcatcatttttga

SEQ ID NO: 29625 - DNA, 17 bp, Homo sapiens
gatcatgtttgcttgtg

SEQ ID NO: 29626 - DNA, 17 bp, Homo sapiens
gatctggaatcctgact

SEQ ID NO: 29627 - DNA, 17 bp, Homo sapiens
gatctatttccatatct

SEQ ID NO: 29628 - DNA, 17 bp, Homo sapiens
gatcaaaatttataact

SEQ ID NO: 29629 - DNA, 17 bp, Homo sapiens
gatctcagtgattgatg

SEQ ID NO: 29630 - DNA, 17 bp, Homo sapiens
gatcaagtgtgacggca

SEQ ID NO: 29631 - DNA, 17 bp, Homo sapiens
gatctggacaatgacaa

SEQ ID NO: 29632 - DNA, 17 bp, Homo sapiens
gatctttctgaagagct

SEQ ID NO: 29633 - DNA, 17 bp, Homo sapiens
gatcctccagaaagagc

SEQ ID NO: 29634 - DNA, 17 bp, Homo sapiens
gatctgacaagtataat

SEQ ID NO: 29635 - DNA, 17 bp, Homo sapiens
gatcactgggctgcaga

SEQ ID NO: 29636 - DNA, 17 bp, Homo sapiens
gatcatcgacaaggaca

SEQ ID NO: 29637 - DNA, 17 bp, Homo sapiens
gatcctttacagaaaca

SEQ ID NO: 29638 - DNA, 17 bp, Homo sapiens
gatctggggcttccact

SEQ ID NO: 29639 - DNA, 17 bp, Homo sapiens
gatctgtccagtgagat

SEQ ID NO: 29640 - DNA, 17 bp, Homo sapiens
gatctaggagaaaaggg

SEQ ID NO: 29641 - DNA, 17 bp, Homo sapiens
gatccttaaccgcccag

SEQ ID NO: 29642 - DNA, 17 bp, Homo sapiens
gatcctgaagataaata

SEQ ID NO: 29643 - DNA, 17 bp, Homo sapiens
gatcctgcatctttttg

SEQ ID NO: 29644 - DNA, 17 bp, Homo sapiens
gatcctaacagcttgca

SEQ ID NO: 29645 - DNA, 17 bp, Homo sapiens
gatccacttccgctgga

SEQ ID NO: 29646 - DNA, 17 bp, Homo sapiens
gatcctgactaagatag

SEQ ID NO: 29647 - DNA, 17 bp, Homo sapiens
gatcatggagaagtttg

SEQ ID NO: 29648 - DNA, 17 bp, Homo sapiens
gatcgtgttcatggagc

SEQ ID NO: 29649 - DNA, 17 bp, Homo sapiens
gatcaaaatggtgcatt

SEQ ID NO: 29650 - DNA, 17 bp, Homo sapiens
gatccgttccctccacg

SEQ ID NO: 29651 - DNA, 17 bp, Homo sapiens
gatcaaactctgtagca

SEQ ID NO: 29652 - DNA, 17 bp, Homo sapiens
gatcattaaacatcagc

SEQ ID NO: 29653 - DNA, 17 bp, Homo sapiens
gatcagattgctgtttt

SEQ ID NO: 29654 - DNA, 17 bp, Homo sapiens
gatctgcattgtgaaaa

SEQ ID NO: 29655 - DNA, 17 bp, Homo sapiens
gatcacgcagtgctttc

SEQ ID NO: 29656 - DNA, 17 bp, Homo sapiens
gatcattgataagccct

SEQ ID NO: 29657 - DNA, 17 bp, Homo sapiens
gatcctttatcttttca

SEQ ID NO: 29658 - DNA, 17 bp, Homo sapiens
gatcggcactcacgatt

SEQ ID NO: 29659 - DNA, 17 bp, Homo sapiens
gatctccactcctctcc

SEQ ID NO: 29660 - DNA, 17 bp, Homo sapiens
gatcgtagacaaccatt

SEQ ID NO: 29661 - DNA, 17 bp, Homo sapiens
gatcttcctgtcatgaa

SEQ ID NO: 29662 - DNA, 17 bp, Homo sapiens
gatcaaaatgaaaaagg

SEQ ID NO: 29663 - DNA, 17 bp, Homo sapiens
gatctcttctgacctgc

SEQ ID NO: 29664 - DNA, 17 bp, Homo sapiens
gatcaaatggtactgat

SEQ ID NO: 29665 - DNA, 17 bp, Homo sapiens
gatcctcctggcttatc

SEQ ID NO: 29666 - DNA, 17 bp, Homo sapiens
gatccacagtaaaggac

SEQ ID NO: 29667 - DNA, 17 bp, Homo sapiens
gatctagaaactcacct

SEQ ID NO: 29668 - DNA, 17 bp, Homo sapiens
gatctgggagggcgagt

SEQ ID NO: 29669 - DNA, 17 bp, Homo sapiens
gatcccaaaggactatg

SEQ ID NO: 29670 - DNA, 17 bp, Homo sapiens
gatctactattatgtta

SEQ ID NO: 29671 - DNA, 17 bp, Homo sapiens
gatctagaacagtcttt

SEQ ID NO: 29672 - DNA, 17 bp, Homo sapiens
gatcaataccaaaagac

SEQ ID NO: 29673 - DNA, 17 bp, Homo sapiens
gatcaatcctcacaatt

SEQ ID NO: 29674 - DNA, 17 bp, Homo sapiens
gatcctgcctctacgga

SEQ ID NO: 29675 - DNA, 17 bp, Homo sapiens
gatcccctgcagtcacc

SEQ ID NO: 29676 - DNA, 17 bp, Homo sapiens
gatcacaagcttcacat

SEQ ID NO: 29677 - DNA, 17 bp, Homo sapiens
gatctccctgtaaaaca

SEQ ID NO: 29678 - DNA, 17 bp, Homo sapiens
gatcatcccaaccacat

SEQ ID NO: 29679 - DNA, 17 bp, Homo sapiens
gatccccgactcattaa

SEQ ID NO: 29680 - DNA, 17 bp, Homo sapiens
gatccttaaaatgacct

SEQ ID NO: 29681 - DNA, 17 bp, Homo sapiens
gatctttcccttaaaac

SEQ ID NO: 29682 - DNA, 17 bp, Homo sapiens
gatctgtgcatattcac

SEQ ID NO: 29683 - DNA, 17 bp, Homo sapiens
gatcacttctgaagtaa

SEQ ID NO: 29684 - DNA, 17 bp, Homo sapiens
gatcttagacaagtcat

SEQ ID NO: 29685 - DNA, 17 bp, Homo sapiens
gatcaagtcatccgcca

SEQ ID NO: 29686 - DNA, 17 bp, Homo sapiens
gatcctgaagtggcccc

SEQ ID NO: 29687 - DNA, 17 bp, Homo sapiens
gatcgccccactacact

SEQ ID NO: 29688 - DNA, 17 bp, Homo sapiens
gatccttccgccttagc

SEQ ID NO: 29689 - DNA, 17 bp, Homo sapiens
gatcctgaatgagacaa

SEQ ID NO: 29690 - DNA, 17 bp, Homo sapiens
gatctgttgggttaaat

SEQ ID NO: 29691 - DNA, 17 bp, Homo sapiens
gatccatttgctctagc

SEQ ID NO: 29692 - DNA, 17 bp, Homo sapiens
gatcttcaaggatatgt

SEQ ID NO: 29693 - DNA, 17 bp, Homo sapiens
gatcacctgtgacatga

SEQ ID NO: 29694 - DNA, 17 bp, Homo sapiens
gatctcttgaaatcccc

SEQ ID NO: 29695 - DNA, 17 bp, Homo sapiens
gatcctgagaggagtgg

SEQ ID NO: 29696 - DNA, 17 bp, Homo sapiens
gatctgtttcccaacat

SEQ ID NO: 29697 - DNA, 17 bp, Homo sapiens
gatcaaccacaggtaac

SEQ ID NO: 29698 - DNA, 17 bp, Homo sapiens
gatcctagagcacttgc

SEQ ID NO: 29699 - DNA, 17 bp, Homo sapiens
gatctggcatatttcat

SEQ ID NO: 29700 - DNA, 17 bp, Homo sapiens
gatcagcatgagaggaa

SEQ ID NO: 29701 - DNA, 17 bp, Homo sapiens
gatccctgacccttggc

SEQ ID NO: 29702 - DNA, 17 bp, Homo sapiens
gatcttgcaccaagact

SEQ ID NO: 29703 - DNA, 17 bp, Homo sapiens
gatcaagatttgtagga

SEQ ID NO: 29704 - DNA, 17 bp, Homo sapiens
gatccgatagaatattt

SEQ ID NO: 29705 - DNA, 17 bp, Homo sapiens
gatccatccataaaaag

SEQ ID NO: 29706 - DNA, 17 bp, Homo sapiens
gatcgtcattcagaatc

SEQ ID NO: 29707 - DNA, 17 bp, Homo sapiens
gatcttacaaacctgca

SEQ ID NO: 29708 - DNA, 17 bp, Homo sapiens
gatcaaacgccctgaga

SEQ ID NO: 29709 - DNA, 17 bp, Homo sapiens
gatctgtttcttttttc

SEQ ID NO: 29710 - DNA, 17 bp, Homo sapiens
gatccaaatgaattcaa

SEQ ID NO: 29711 - DNA, 17 bp, Homo sapiens
gatcagaaagaatctct

SEQ ID NO: 29712 - DNA, 17 bp, Homo sapiens
gatcttctgttattaaa

SEQ ID NO: 29713 - DNA, 17 bp, Homo sapiens
gatcagggcactattcc

SEQ ID NO: 29714 - DNA, 17 bp, Homo sapiens
gatcttttctttttacc

SEQ ID NO: 29715 - DNA, 17 bp, Homo sapiens
gatcgtttttcttacaa

SEQ ID NO: 29716 - DNA, 17 bp, Homo sapiens
gatccagcagtcttggg

SEQ ID NO: 29717 - DNA, 17 bp, Homo sapiens
gatccgcgacttcaaca

SEQ ID NO: 29718 - DNA, 17 bp, Homo sapiens
gatcccaggacactaca

SEQ ID NO: 29719 - DNA, 17 bp, Homo sapiens
gatctgggagggtcggg

SEQ ID NO: 29720 - DNA, 17 bp, Homo sapiens
gatcacaagtagcaaat

SEQ ID NO: 29721 - DNA, 17 bp, Homo sapiens
gatcacaccagaagatg

SEQ ID NO: 29722 - DNA, 17 bp, Homo sapiens
gatctgccatagcttac

SEQ ID NO: 29723 - DNA, 17 bp, Homo sapiens
gatcaagatgtgcgcaa

SEQ ID NO: 29724 - DNA, 17 bp, Homo sapiens
gatccttggaattatcc

SEQ ID NO: 29725 - DNA, 17 bp, Homo sapiens
gatccagaaggtaaagg

SEQ ID NO: 29726 - DNA, 17 bp, Homo sapiens
gatcctgttctcacatt

SEQ ID NO: 29727 - DNA, 17 bp, Homo sapiens
gatcccgagtacatcta

SEQ ID NO: 29728 - DNA, 17 bp, Homo sapiens
gatcgcttcttaggagt

SEQ ID NO: 29729 - DNA, 17 bp, Homo sapiens
gatccaatcaaacctca

SEQ ID NO: 29730 - DNA, 17 bp, Homo sapiens
gatccagaagccctttt

SEQ ID NO: 29731 - DNA, 17 bp, Homo sapiens
gatctatgaaaaagcac

SEQ ID NO: 29732 - DNA, 17 bp, Homo sapiens
gatccagccctaacacg

SEQ ID NO: 29733 - DNA, 17 bp, Homo sapiens
gatcctcagaccaggac

SEQ ID NO: 29734 - DNA, 17 bp, Homo sapiens
gatcttctggggactgg

SEQ ID NO: 29735 - DNA, 17 bp, Homo sapiens
gatcacttcccagtcca

SEQ ID NO: 29736 - DNA, 17 bp, Homo sapiens
gatctggaagtatccct

SEQ ID NO: 29737 - DNA, 17 bp, Homo sapiens
gatcccaaatgagaggg

SEQ ID NO: 29738 - DNA, 17 bp, Homo sapiens
gatcaagaatttttcaa

SEQ ID NO: 29739 - DNA, 17 bp, Homo sapiens
gatcaggctcgccaggg

SEQ ID NO: 29740 - DNA, 17 bp, Homo sapiens
gatccttaagatgcaat

SEQ ID NO: 29741 - DNA, 17 bp, Homo sapiens
gatctgagctaaacagg

SEQ ID NO: 29742 - DNA, 17 bp, Homo sapiens
gatctccagtcctgacc

SEQ ID NO: 29743 - DNA, 17 bp, Homo sapiens
gatctgtgcaggcacag

SEQ ID NO: 29744 - DNA, 17 bp, Homo sapiens
gatccagttggcccact

SEQ ID NO: 29745 - DNA, 17 bp, Homo sapiens
gatccccagaactcttg

SEQ ID NO: 29746 - DNA, 17 bp, Homo sapiens
gatcatcctgaacctaa

SEQ ID NO: 29747 - DNA, 17 bp, Homo sapiens
gatcctagggccatttt

SEQ ID NO: 29748 - DNA, 17 bp, Homo sapiens
gatcctgccctccagcc

SEQ ID NO: 29749 - DNA, 17 bp, Homo sapiens
gatctcagagagcaaca

SEQ ID NO: 29750 - DNA, 17 bp, Homo sapiens
gatcctctgtgagttca

SEQ ID NO: 29751 - DNA, 17 bp, Homo sapiens
gatcaaaacgtggagta

SEQ ID NO: 29752 - DNA, 17 bp, Homo sapiens
gatctctgtgaagaaca

SEQ ID NO: 29753 - DNA, 17 bp, Homo sapiens
gatccccccaaacacca

SEQ ID NO: 29754 - DNA, 17 bp, Homo sapiens
gatccccaccagtcaac

SEQ ID NO: 29755 - DNA, 17 bp, Homo sapiens
gatctcagccactgttg

SEQ ID NO: 29756 - DNA, 17 bp, Homo sapiens
gatctcatcaaggactc

SEQ ID NO: 29757 - DNA, 17 bp, Homo sapiens
gatctccacaagtttgg

SEQ ID NO: 29758 - DNA, 17 bp, Homo sapiens
gatctcagcagattcgg

SEQ ID NO: 29759 - DNA, 17 bp, Homo sapiens
gatctcctaagaagtgt

SEQ ID NO: 29760 - DNA, 17 bp, Homo sapiens
gatcctgctctgctaca

SEQ ID NO: 29761 - DNA, 17 bp, Homo sapiens
gatcatcatgtacagag

SEQ ID NO: 29762 - DNA, 17 bp, Homo sapiens
gatctttgccacaaata

SEQ ID NO: 29763 - DNA, 17 bp, Homo sapiens
gatcccaaacaccagcc

SEQ ID NO: 29764 - DNA, 17 bp, Homo sapiens
gatcagagaaattccaa

SEQ ID NO: 29765 - DNA, 17 bp, Homo sapiens
gatcataataatccaca

SEQ ID NO: 29766 - DNA, 17 bp, Homo sapiens
gatcctactacttgccg

SEQ ID NO: 29767 - DNA, 17 bp, Homo sapiens
gatcagaaatcaagaaa

SEQ ID NO: 29768 - DNA, 17 bp, Homo sapiens
gatcaagcttgccaccg

SEQ ID NO: 29769 - DNA, 17 bp, Homo sapiens
gatcattgttaaccaat

SEQ ID NO: 29770 - DNA, 17 bp, Homo sapiens
gatccaagacatctggt

SEQ ID NO: 29771 - DNA, 17 bp, Homo sapiens
gatcaaggctgggggtt

SEQ ID NO: 29772 - DNA, 17 bp, Homo sapiens
gatccacatccctgtat

SEQ ID NO: 29773 - DNA, 17 bp, Homo sapiens
gatcagaagaaatcctt

SEQ ID NO: 29774 - DNA, 17 bp, Homo sapiens
gatcttcatcctgtaga

SEQ ID NO: 29775 - DNA, 17 bp, Homo sapiens
gatccccacattgttcc

SEQ ID NO: 29776 - DNA, 17 bp, Homo sapiens
gatctgggttagggaga

SEQ ID NO: 29777 - DNA, 17 bp, Homo sapiens
gatcaataccagcaggt

SEQ ID NO: 29778 - DNA, 17 bp, Homo sapiens
gatcggcattttgttca

SEQ ID NO: 29779 - DNA, 17 bp, Homo sapiens
gatccacccacccattt

SEQ ID NO: 29780 - DNA, 17 bp, Homo sapiens
gatcatcaatatctaaa

SEQ ID NO: 29781 - DNA, 17 bp, Homo sapiens
gatccaaagcttttcgt

SEQ ID NO: 29782 - DNA, 17 bp, Homo sapiens
gatctgaaataaactcc

SEQ ID NO: 29783 - DNA, 17 bp, Homo sapiens
gatcaaagtcagacagc

SEQ ID NO: 29784 - DNA, 17 bp, Homo sapiens
gatcttactgttgtaca

SEQ ID NO: 29785 - DNA, 17 bp, Homo sapiens
gatcttttaagcaagga

SEQ ID NO: 29786 - DNA, 17 bp, Homo sapiens
gatctgaaaagagaatt

SEQ ID NO: 29787 - DNA, 17 bp, Homo sapiens
gatcaaagttccaggcc

SEQ ID NO: 29788 - DNA, 17 bp, Homo sapiens
gatccatgtattagtgt

SEQ ID NO: 29789 - DNA, 17 bp, Homo sapiens
gatccgtgtattagtgt

SEQ ID NO: 29790 - DNA, 17 bp, Homo sapiens
gatctcaccaggtctct

SEQ ID NO: 29791 - DNA, 17 bp, Homo sapiens
gatctcctgctatcctt

SEQ ID NO: 29792 - DNA, 17 bp, Homo sapiens
gatcgccacctaccacc

SEQ ID NO: 29793 - DNA, 17 bp, Homo sapiens
gatcaccttttccttcc

SEQ ID NO: 29794 - DNA, 17 bp, Homo sapiens
gatcttcaccttaaaat

SEQ ID NO: 29795 - DNA, 17 bp, Homo sapiens
gatcttagcaagagagt

SEQ ID NO: 29796 - DNA, 17 bp, Homo sapiens
gatctgtctgatatcac

SEQ ID NO: 29797 - DNA, 17 bp, Homo sapiens
gatcctgtaccacatct

SEQ ID NO: 29798 - DNA, 17 bp, Homo sapiens
gatcaataaatgcgatt

SEQ ID NO: 29799 - DNA, 17 bp, Homo sapiens
gatccccccaagccttg

SEQ ID NO: 29800 - DNA, 17 bp, Homo sapiens
gatctggaattcaaact

SEQ ID NO: 29801 - DNA, 17 bp, Homo sapiens
gatcttcctcaccagct

SEQ ID NO: 29802 - DNA, 17 bp, Homo sapiens
gatcacatatgtcctca

SEQ ID NO: 29803 - DNA, 17 bp, Homo sapiens
gatctaaggtctgggga

SEQ ID NO: 29804 - DNA, 17 bp, Homo sapiens
gatccaggcgttggagg

SEQ ID NO: 29805 - DNA, 17 bp, Homo sapiens
gatcgatgagaagagtc

SEQ ID NO: 29806 - DNA, 17 bp, Homo sapiens
gatcagcaataaaatcc

SEQ ID NO: 29807 - DNA, 17 bp, Homo sapiens
gatcagccttatcctgg

SEQ ID NO: 29808 - DNA, 17 bp, Homo sapiens
gatcattcagacggcac

SEQ ID NO: 29809 - DNA, 17 bp, Homo sapiens
gatcacatgacctcatc

SEQ ID NO: 29810 - DNA, 17 bp, Homo sapiens
gatcccagcctccattc

SEQ ID NO: 29811 - DNA, 17 bp, Homo sapiens
gatcacctatggacaca

SEQ ID NO: 29812 - DNA, 17 bp, Homo sapiens
gatccaagagaagaaca

SEQ ID NO: 29813 - DNA, 17 bp, Homo sapiens
gatcatggtggtcactg

SEQ ID NO: 29814 - DNA, 17 bp, Homo sapiens
gatccaaagaccaaagt

SEQ ID NO: 29815 - DNA, 17 bp, Homo sapiens
gatcctcaagaaatcat

SEQ ID NO: 29816 - DNA, 17 bp, Homo sapiens
gatccagctgtatttcc

SEQ ID NO: 29817 - DNA, 17 bp, Homo sapiens
gatcgctgcctgacaga

SEQ ID NO: 29818 - DNA, 17 bp, Homo sapiens
gatctggatgtgtggag

SEQ ID NO: 29819 - DNA, 17 bp, Homo sapiens
gatccctgaagtgggag

SEQ ID NO: 29820 - DNA, 17 bp, Homo sapiens
gatctaaccgtatgaag

SEQ ID NO: 29821 - DNA, 17 bp, Homo sapiens
gatccttctatcttctc

SEQ ID NO: 29822 - DNA, 17 bp, Homo sapiens
gatctaaagtgaaagta

SEQ ID NO: 29823 - DNA, 17 bp, Homo sapiens
gatcatttgaaggtgca

SEQ ID NO: 29824 - DNA, 17 bp, Homo sapiens
gatctaacatagaagct

SEQ ID NO: 29825 - DNA, 17 bp, Homo sapiens
gatcatctactcacact

SEQ ID NO: 29826 - DNA, 17 bp, Homo sapiens
gatcccaggttggtaaa

SEQ ID NO: 29827 - DNA, 17 bp, Homo sapiens
gatcgtgcaggaccacc

SEQ ID NO: 29828 - DNA, 17 bp, Homo sapiens
gatctcttctaaatata

SEQ ID NO: 29829 - DNA, 17 bp, Homo sapiens
gatctgagcagtcaact

SEQ ID NO: 29830 - DNA, 17 bp, Homo sapiens
gatcccttttttgtctc

SEQ ID NO: 29831 - DNA, 17 bp, Homo sapiens
gatctgtatgtctgtag

SEQ ID NO: 29832 - DNA, 17 bp, Homo sapiens
gatccaacccaagggca

SEQ ID NO: 29833 - DNA, 17 bp, Homo sapiens
gatctgaaggactaaaa

SEQ ID NO: 29834 - DNA, 17 bp, Homo sapiens
gatcacacctgtgtttt

SEQ ID NO: 29835 - DNA, 17 bp, Homo sapiens
gatccagttgggaatgc

SEQ ID NO: 29836 - DNA, 17 bp, Homo sapiens
gatccagacaggggctc

SEQ ID NO: 29837 - DNA, 17 bp, Homo sapiens
gatcttcataatcatat

SEQ ID NO: 29838 - DNA, 17 bp, Homo sapiens
gatcctgaagtcgtgaa

SEQ ID NO: 29839 - DNA, 17 bp, Homo sapiens
gatccaggctcgccaag

SEQ ID NO: 29840 - DNA, 17 bp, Homo sapiens
gatctagtccaacttcc

SEQ ID NO: 29841 - DNA, 17 bp, Homo sapiens
gatctgagaaccaacca

SEQ ID NO: 29842 - DNA, 17 bp, Homo sapiens
gatcctaaagcacacca

SEQ ID NO: 29843 - DNA, 17 bp, Homo sapiens
gatccctccctccttga

SEQ ID NO: 29844 - DNA, 17 bp, Homo sapiens
gatcaaacgccaagaga

SEQ ID NO: 29845 - DNA, 17 bp, Homo sapiens
gatctgaacagcaaagt

SEQ ID NO: 29846 - DNA, 17 bp, Homo sapiens
gatctagaaaaacattt

SEQ ID NO: 29847 - DNA, 17 bp, Homo sapiens
gatccagtttgaaaaaa

SEQ ID NO: 29848 - DNA, 17 bp, Homo sapiens
gatcaaatgtttatgta

SEQ ID NO: 29849 - DNA, 17 bp, Homo sapiens
gatcgtctccattttta

SEQ ID NO: 29850 - DNA, 17 bp, Homo sapiens
gatcatggaaaagaaat

SEQ ID NO: 29851 - DNA, 17 bp, Homo sapiens
gatcctgtctagagatt

SEQ ID NO: 29852 - DNA, 17 bp, Homo sapiens
gatcccaagttaaatcc

SEQ ID NO: 29853 - DNA, 17 bp, Homo sapiens
gatctttctatttctca

SEQ ID NO: 29854 - DNA, 17 bp, Homo sapiens
gatcgaagtgttccgtc

SEQ ID NO: 29855 - DNA, 17 bp, Homo sapiens
gatcgtgcagtacagcc

SEQ ID NO: 29856 - DNA, 17 bp, Homo sapiens
gatcgactaatgcagtt

SEQ ID NO: 29857 - DNA, 17 bp, Homo sapiens
gatctgccattaaaaga

SEQ ID NO: 29858 - DNA, 17 bp, Homo sapiens
gatcgatgcttagtgag

SEQ ID NO: 29859 - DNA, 17 bp, Homo sapiens
gatcacagtgatgctcc

SEQ ID NO: 29860 - DNA, 17 bp, Homo sapiens
gatcctgtggtaaaagt

SEQ ID NO: 29861 - DNA, 17 bp, Homo sapiens
gatccaccactgtacta

SEQ ID NO: 29862 - DNA, 17 bp, Homo sapiens
gatcaccttcttgaccg

SEQ ID NO: 29863 - DNA, 17 bp, Homo sapiens
gatcctgaatctgtgca

SEQ ID NO: 29864 - DNA, 17 bp, Homo sapiens
gatcaaatgtttcaaga

SEQ ID NO: 29865 - DNA, 17 bp, Homo sapiens
gatctcaaagatgtgcc

SEQ ID NO: 29866 - DNA, 17 bp, Homo sapiens
gatcagctatgacaaat

SEQ ID NO: 29867 - DNA, 17 bp, Homo sapiens
gatctggaagaggagag

SEQ ID NO: 29868 - DNA, 17 bp, Homo sapiens
gatcatgtttgtgaaaa

SEQ ID NO: 29869 - DNA, 17 bp, Homo sapiens
gatccccgctttcacag

SEQ ID NO: 29870 - DNA, 17 bp, Homo sapiens
gatcttgctggactcag

SEQ ID NO: 29871 - DNA, 17 bp, Homo sapiens
gatctattaggtggacc

SEQ ID NO: 29872 - DNA, 17 bp, Homo sapiens
gatcacatatttgccga

SEQ ID NO: 29873 - DNA, 17 bp, Homo sapiens
gatctgttacttcctcc

SEQ ID NO: 29874 - DNA, 17 bp, Homo sapiens
gatcaaaattccttggt

SEQ ID NO: 29875 - DNA, 17 bp, Homo sapiens
gatcagaaggctctggt

SEQ ID NO: 29876 - DNA, 17 bp, Homo sapiens
gatctgatttttaaaaa

SEQ ID NO: 29877 - DNA, 17 bp, Homo sapiens
gatcgatttcatcaaat

SEQ ID NO: 29878 - DNA, 17 bp, Homo sapiens
gatctatccgttcttta

SEQ ID NO: 29879 - DNA, 17 bp, Homo sapiens
gatcctttgtgtccaaa

SEQ ID NO: 29880 - DNA, 17 bp, Homo sapiens
gatcacaaaataaactc

SEQ ID NO: 29881 - DNA, 17 bp, Homo sapiens
gatcctgctacctcata

SEQ ID NO: 29882 - DNA, 17 bp, Homo sapiens
gatccccttgccaaaac

SEQ ID NO: 29883 - DNA, 17 bp, Homo sapiens
gatcctttcaaagcact

SEQ ID NO: 29884 - DNA, 17 bp, Homo sapiens
gatcacagttatatttt

SEQ ID NO: 29885 - DNA, 17 bp, Homo sapiens
gatcgtgcctgtggcta

SEQ ID NO: 29886 - DNA, 17 bp, Homo sapiens
gatcaccacattgtttt

SEQ ID NO: 29887 - DNA, 17 bp, Homo sapiens
gatcaaggccttattta

SEQ ID NO: 29888 - DNA, 17 bp, Homo sapiens
gatccttcagaaggcaa

SEQ ID NO: 29889 - DNA, 17 bp, Homo sapiens
gatcaaaaatattttct

SEQ ID NO: 29890 - DNA, 17 bp, Homo sapiens
gatctggacgcatgata

SEQ ID NO: 29891 - DNA, 17 bp, Homo sapiens
gatccttggagtcagta

SEQ ID NO: 29892 - DNA, 17 bp, Homo sapiens
gatcccaggggacactt

SEQ ID NO: 29893 - DNA, 17 bp, Homo sapiens
gatctcagtttttgcaa

SEQ ID NO: 29894 - DNA, 17 bp, Homo sapiens
gatctccgactcggctc

SEQ ID NO: 29895 - DNA, 17 bp, Homo sapiens
gatcagcggttgacccc

SEQ ID NO: 29896 - DNA, 17 bp, Homo sapiens
gatcagtttggagatat

SEQ ID NO: 29897 - DNA, 17 bp, Homo sapiens
gatctatttctttctcg

SEQ ID NO: 29898 - DNA, 17 bp, Homo sapiens
gatcacatgtccctcca

SEQ ID NO: 29899 - DNA, 17 bp, Homo sapiens
gatcggtcttcagtcaa

SEQ ID NO: 29900 - DNA, 17 bp, Homo sapiens
gatcctgaactaagtgg

SEQ ID NO: 29901 - DNA, 17 bp, Homo sapiens
gatctgtaaacagagct

SEQ ID NO: 29902 - DNA, 17 bp, Homo sapiens
gatcacaatcaagctac

SEQ ID NO: 29903 - DNA, 17 bp, Homo sapiens
gatcctgtggaatgaaa

SEQ ID NO: 29904 - DNA, 17 bp, Homo sapiens
gatcaacctttaattca

SEQ ID NO: 29905 - DNA, 17 bp, Homo sapiens
gatcaaagctggaagaa

SEQ ID NO: 29906 - DNA, 17 bp, Homo sapiens
gatcaaatctgcttttc

SEQ ID NO: 29907 - DNA, 17 bp, Homo sapiens
gatcaatggctgctgat

SEQ ID NO: 29908 - DNA, 17 bp, Homo sapiens
gatcctcctgagaagct

SEQ ID NO: 29909 - DNA, 17 bp, Homo sapiens
gatcatacagcaaggac

SEQ ID NO: 29910 - DNA, 17 bp, Homo sapiens
gatcagaatattttggt

SEQ ID NO: 29911 - DNA, 17 bp, Homo sapiens
gatcacagctcccactt

SEQ ID NO: 29912 - DNA, 17 bp, Homo sapiens
gatcttacagtgcctgt

SEQ ID NO: 29913 - DNA, 17 bp, Homo sapiens
gatcccataccggtact

SEQ ID NO: 29914 - DNA, 17 bp, Homo sapiens
gatcaagtctgactggc

SEQ ID NO: 29915 - DNA, 17 bp, Homo sapiens
gatcaagcatgagcttc

SEQ ID NO: 29916 - DNA, 17 bp, Homo sapiens
gatcatacttgcaggga

SEQ ID NO: 29917 - DNA, 17 bp, Homo sapiens
gatcaaactgggcccag

SEQ ID NO: 29918 - DNA, 17 bp, Homo sapiens
gatcaactacctgattt

SEQ ID NO: 29919 - DNA, 17 bp, Homo sapiens
gatcgattacttctgct

SEQ ID NO: 29920 - DNA, 17 bp, Homo sapiens
gatcctgagcagtggga

SEQ ID NO: 29921 - DNA, 17 bp, Homo sapiens
gatcatagatacaggat

SEQ ID NO: 29922 - DNA, 17 bp, Homo sapiens
gatccttaattgaatcc

SEQ ID NO: 29923 - DNA, 17 bp, Homo sapiens
gatcggtgtctgggctc

SEQ ID NO: 29924 - DNA, 17 bp, Homo sapiens
gatcaagccaaagaatt

SEQ ID NO: 29925 - DNA, 17 bp, Homo sapiens
gatctggggcggtggca

SEQ ID NO: 29926 - DNA, 17 bp, Homo sapiens
gatcaaagtaccttgcc

SEQ ID NO: 29927 - DNA, 17 bp, Homo sapiens
gatcctggccgaggtgg

SEQ ID NO: 29928 - DNA, 17 bp, Homo sapiens
gatcgttacaaagctca

SEQ ID NO: 29929 - DNA, 17 bp, Homo sapiens
gatcacagtgagaaacc

SEQ ID NO: 29930 - DNA, 17 bp, Homo sapiens
gatccaatttgatgata

SEQ ID NO: 29931 - DNA, 17 bp, Homo sapiens
gatcttcaggaaacatt

SEQ ID NO: 29932 - DNA, 17 bp, Homo sapiens
gatcttttacttattca

SEQ ID NO: 29933 - DNA, 17 bp, Homo sapiens
gatctgttggttgaaat

SEQ ID NO: 29934 - DNA, 17 bp, Homo sapiens
gatcctgtaggaaatat

SEQ ID NO: 29935 - DNA, 17 bp, Homo sapiens
gatcagattttctggga

SEQ ID NO: 29936 - DNA, 17 bp, Homo sapiens
gatcataagctaaatgt

SEQ ID NO: 29937 - DNA, 17 bp, Homo sapiens
gatctatatctgctatg

SEQ ID NO: 29938 - DNA, 17 bp, Homo sapiens
gatctttcccatactgg

SEQ ID NO: 29939 - DNA, 17 bp, Homo sapiens
gatccaagcaaaataaa

SEQ ID NO: 29940 - DNA, 17 bp, Homo sapiens
gatccataaaactgtga

SEQ ID NO: 29941 - DNA, 17 bp, Homo sapiens
gatctcacacattcgcc

SEQ ID NO: 29942 - DNA, 17 bp, Homo sapiens
gatctgtgtttttccaa

SEQ ID NO: 29943 - DNA, 17 bp, Homo sapiens
gatcacattactggctg

SEQ ID NO: 29944 - DNA, 17 bp, Homo sapiens
gatccagaagcagcagg

SEQ ID NO: 29945 - DNA, 17 bp, Homo sapiens
gatccaggaaatatttg

SEQ ID NO: 29946 - DNA, 17 bp, Homo sapiens
gatcgcaccctgggtca

SEQ ID NO: 29947 - DNA, 17 bp, Homo sapiens
gatctcccctaacagtg

SEQ ID NO: 29948 - DNA, 17 bp, Homo sapiens
gatcactctattctcaa

SEQ ID NO: 29949 - DNA, 17 bp, Homo sapiens
gatcaatagagaagata

SEQ ID NO: 29950 - DNA, 17 bp, Homo sapiens
gatcacagggtcgttct

SEQ ID NO: 29951 - DNA, 17 bp, Homo sapiens
gatctaagattaccaca

SEQ ID NO: 29952 - DNA, 17 bp, Homo sapiens
gatcacgaagaagtttt

SEQ ID NO: 29953 - DNA, 17 bp, Homo sapiens
gatcaaacagaagcttt

SEQ ID NO: 29954 - DNA, 17 bp, Homo sapiens
gatcttcccagagtaca

SEQ ID NO: 29955 - DNA, 17 bp, Homo sapiens
gatcctgggtcgtgacc

SEQ ID NO: 29956 - DNA, 17 bp, Homo sapiens
gatcgccacaagtagca

SEQ ID NO: 29957 - DNA, 17 bp, Homo sapiens
gatctgacactgagtct

SEQ ID NO: 29958 - DNA, 17 bp, Homo sapiens
gatccagcactgccgag

SEQ ID NO: 29959 - DNA, 17 bp, Homo sapiens
gatccccattcccactt

SEQ ID NO: 29960 - DNA, 17 bp, Homo sapiens
gatcatttcctgttctc

SEQ ID NO: 29961 - DNA, 17 bp, Homo sapiens
gatctcaatggcgggaa

SEQ ID NO: 29962 - DNA, 17 bp, Homo sapiens
gatccctctatcccggg

SEQ ID NO: 29963 - DNA, 17 bp, Homo sapiens
gatcaaaatagtacttg

SEQ ID NO: 29964 - DNA, 17 bp, Homo sapiens
gatctgctttctgtttg

SEQ ID NO: 29965 - DNA, 17 bp, Homo sapiens
gatcctgaaatgttgtc

SEQ ID NO: 29966 - DNA, 17 bp, Homo sapiens
gatcatttgtggttccc

SEQ ID NO: 29967 - DNA, 17 bp, Homo sapiens
gatccaccaccaaaggc

SEQ ID NO: 29968 - DNA, 17 bp, Homo sapiens
gatctttctgccctccc

SEQ ID NO: 29969 - DNA, 17 bp, Homo sapiens
gatcccacaatcacggt

SEQ ID NO: 29970 - DNA, 17 bp, Homo sapiens
gatctacccttaacgta

SEQ ID NO: 29971 - DNA, 17 bp, Homo sapiens
gatccccttctacatgg

SEQ ID NO: 29972 - DNA, 17 bp, Homo sapiens
gatctcaggtaaccatt

SEQ ID NO: 29973 - DNA, 17 bp, Homo sapiens
gatcccaggagtccttc

SEQ ID NO: 29974 - DNA, 17 bp, Homo sapiens
gatcctgaataaagtct

SEQ ID NO: 29975 - DNA, 17 bp, Homo sapiens
gatcttctcgtggatgt

SEQ ID NO: 29976 - DNA, 17 bp, Homo sapiens
gatcgaataagatgatg

SEQ ID NO: 29977 - DNA, 17 bp, Homo sapiens
gatcagtgcagaactca

SEQ ID NO: 29978 - DNA, 17 bp, Homo sapiens
gatcaccctcatctgaa

SEQ ID NO: 29979 - DNA, 17 bp, Homo sapiens
gatccccttaactatgt

SEQ ID NO: 29980 - DNA, 17 bp, Homo sapiens
gatctgcggtggggtgg

SEQ ID NO: 29981 - DNA, 17 bp, Homo sapiens
gatcaagactcagaagc

SEQ ID NO: 29982 - DNA, 17 bp, Homo sapiens
gatcaactggaccgggt

SEQ ID NO: 29983 - DNA, 17 bp, Homo sapiens
gatctcatctctccgtc

SEQ ID NO: 29984 - DNA, 17 bp, Homo sapiens
gatctctcttccaataa

SEQ ID NO: 29985 - DNA, 17 bp, Homo sapiens
gatcttcacacacttat

SEQ ID NO: 29986 - DNA, 17 bp, Homo sapiens
gatctcttgagggtggg

SEQ ID NO: 29987 - DNA, 17 bp, Homo sapiens
gatcactaatcccaagg

SEQ ID NO: 29988 - DNA, 17 bp, Homo sapiens
gatcttgtccaaccccc

SEQ ID NO: 29989 - DNA, 17 bp, Homo sapiens
gatcctcaagttcttta

SEQ ID NO: 29990 - DNA, 17 bp, Homo sapiens
gatcttcaacattaaat

SEQ ID NO: 29991 - DNA, 17 bp, Homo sapiens
gatcggatgggtccgaa

SEQ ID NO: 29992 - DNA, 17 bp, Homo sapiens
gatcaccccagcctgtg

SEQ ID NO: 29993 - DNA, 17 bp, Homo sapiens
gatcatttctcaagagt

SEQ ID NO: 29994 - DNA, 17 bp, Homo sapiens
gatcagagccttgtggc

SEQ ID NO: 29995 - DNA, 17 bp, Homo sapiens
gatcatctaaaacaaat

SEQ ID NO: 29996 - DNA, 17 bp, Homo sapiens
gatcttcttcagagttt

SEQ ID NO: 29997 - DNA, 17 bp, Homo sapiens
gatccctctctaacaga

SEQ ID NO: 29998 - DNA, 17 bp, Homo sapiens
gatcttgcaatgttgcc

SEQ ID NO: 29999 - DNA, 17 bp, Homo sapiens
gatctgaataaggactt

SEQ ID NO: 30000 - DNA, 17 bp, Homo sapiens
gatcacaatgcgggttg

SEQ ID NO: 30001 - DNA, 17 bp, Homo sapiens
gatcaccaaataattac

SEQ ID NO: 30002 - DNA, 17 bp, Homo sapiens
gatcatccacaaaataa

SEQ ID NO: 30003 - DNA, 17 bp, Homo sapiens
gatccagccgtgcgctc

SEQ ID NO: 30004 - DNA, 17 bp, Homo sapiens
gatccacatctgcagac

SEQ ID NO: 30005 - DNA, 17 bp, Homo sapiens
gatcccaagacccaagc

SEQ ID NO: 30006 - DNA, 17 bp, Homo sapiens
gatcaacgggagcaatc

SEQ ID NO: 30007 - DNA, 17 bp, Homo sapiens
gatccagagagcccatc

SEQ ID NO: 30008 - DNA, 17 bp, Homo sapiens
gatcttgccattgctcc

SEQ ID NO: 30009 - DNA, 17 bp, Homo sapiens
gatctgtgtcctagaca

SEQ ID NO: 30010 - DNA, 17 bp, Homo sapiens
gatcttacagcaaaaca

SEQ ID NO: 30011 - DNA, 17 bp, Homo sapiens
gatcaagcatgtctctg

SEQ ID NO: 30012 - DNA, 17 bp, Homo sapiens
gatcagatgcctaagga

SEQ ID NO: 30013 - DNA, 17 bp, Homo sapiens
gatcttcctccccaatg

SEQ ID NO: 30014 - DNA, 17 bp, Homo sapiens
gatcctgtttcagcccc

SEQ ID NO: 30015 - DNA, 17 bp, Homo sapiens
gatccttgtatgaatca

SEQ ID NO: 30016 - DNA, 17 bp, Homo sapiens
gatcatcgccctttggg

SEQ ID NO: 30017 - DNA, 17 bp, Homo sapiens
gatcaaaaatcccttat

SEQ ID NO: 30018 - DNA, 17 bp, Homo sapiens
gatcaaaatgctgattg

SEQ ID NO: 30019 - DNA, 17 bp, Homo sapiens
gatctctatatgcagca

SEQ ID NO: 30020 - DNA, 17 bp, Homo sapiens
gatcaggaaacaggcga

SEQ ID NO: 30021 - DNA, 17 bp, Homo sapiens
gatccaaggccagttaa

SEQ ID NO: 30022 - DNA, 17 bp, Homo sapiens
gatcctttcagcctaaa

SEQ ID NO: 30023 - DNA, 17 bp, Homo sapiens
gatcctgcttggggtgt

SEQ ID NO: 30024 - DNA, 17 bp, Homo sapiens
gatcactgatgacctca

SEQ ID NO: 30025 - DNA, 17 bp, Homo sapiens
gatctgctgaatcccaa

SEQ ID NO: 30026 - DNA, 17 bp, Homo sapiens
gatcacatcaatgacaa

SEQ ID NO: 30027 - DNA, 17 bp, Homo sapiens
gatcattctttctcctg

SEQ ID NO: 30028 - DNA, 17 bp, Homo sapiens
gatcacacatttattgg

SEQ ID NO: 30029 - DNA, 17 bp, Homo sapiens
gatctgtaacagggtag

SEQ ID NO: 30030 - DNA, 17 bp, Homo sapiens
gatccacttagcacctc

SEQ ID NO: 30031 - DNA, 17 bp, Homo sapiens
gatcatgttcccctttt

SEQ ID NO: 30032 - DNA, 17 bp, Homo sapiens
gatccttacacttcaca

SEQ ID NO: 30033 - DNA, 17 bp, Homo sapiens
gatcatgtctctgctac

SEQ ID NO: 30034 - DNA, 17 bp, Homo sapiens
gatccagcaagtatccg

SEQ ID NO: 30035 - DNA, 17 bp, Homo sapiens
gatctgtgaacataagt

SEQ ID NO: 30036 - DNA, 17 bp, Homo sapiens
gatcccctcactaaaac

SEQ ID NO: 30037 - DNA, 17 bp, Homo sapiens
gatctcttcagggaagt

SEQ ID NO: 30038 - DNA, 17 bp, Homo sapiens
gatccatgttttcagcg

SEQ ID NO: 30039 - DNA, 17 bp, Homo sapiens
gatcagatgatttctgt

SEQ ID NO: 30040 - DNA, 17 bp, Homo sapiens
gatcaaagccaagcaaa

SEQ ID NO: 30041 - DNA, 17 bp, Homo sapiens
gatctctgccaaatacc

SEQ ID NO: 30042 - DNA, 17 bp, Homo sapiens
gatcacagtgccttact

SEQ ID NO: 30043 - DNA, 17 bp, Homo sapiens
gatcattggtcgtggct

SEQ ID NO: 30044 - DNA, 17 bp, Homo sapiens
gatcacaccgttaccat

SEQ ID NO: 30045 - DNA, 17 bp, Homo sapiens
gatcgtgttttcttgtc

SEQ ID NO: 30046 - DNA, 17 bp, Homo sapiens
gatcactatctgtactg

SEQ ID NO: 30047 - DNA, 17 bp, Homo sapiens
gatctctgaaacattgc

SEQ ID NO: 30048 - DNA, 17 bp, Homo sapiens
gatcaaaaagttgatac

SEQ ID NO: 30049 - DNA, 17 bp, Homo sapiens
gatcccatgttacagga

SEQ ID NO: 30050 - DNA, 17 bp, Homo sapiens
gatcgggggctccatcc

SEQ ID NO: 30051 - DNA, 17 bp, Homo sapiens
gatcgcactgaacctaa

SEQ ID NO: 30052 - DNA, 17 bp, Homo sapiens
gatcagaatgttaaccc

SEQ ID NO: 30053 - DNA, 17 bp, Homo sapiens
gatccctgggaccctca

SEQ ID NO: 30054 - DNA, 17 bp, Homo sapiens
gatccactgtgcacatt

SEQ ID NO: 30055 - DNA, 17 bp, Homo sapiens
gatcgctttattcgtac

SEQ ID NO: 30056 - DNA, 17 bp, Homo sapiens
gatcagttcagaagaaa

SEQ ID NO: 30057 - DNA, 17 bp, Homo sapiens
gatctcgaggagtcccc

SEQ ID NO: 30058 - DNA, 17 bp, Homo sapiens
gatcacccacctcatca

SEQ ID NO: 30059 - DNA, 17 bp, Homo sapiens
gatcctatcagaaacaa

SEQ ID NO: 30060 - DNA, 17 bp, Homo sapiens
gatctacacagaacaac

SEQ ID NO: 30061 - DNA, 17 bp, Homo sapiens
gatcctatatttagcca

SEQ ID NO: 30062 - DNA, 17 bp, Homo sapiens
gatcccagggctccctg

SEQ ID NO: 30063 - DNA, 17 bp, Homo sapiens
gatcaaatgttttgggg

SEQ ID NO: 30064 - DNA, 17 bp, Homo sapiens
gatccactgaaagttga

SEQ ID NO: 30065 - DNA, 17 bp, Homo sapiens
gatccctgcctccccta

SEQ ID NO: 30066 - DNA, 17 bp, Homo sapiens
gatcagttggaaaaaca

SEQ ID NO: 30067 - DNA, 17 bp, Homo sapiens
gatctcatcctggaatg

SEQ ID NO: 30068 - DNA, 17 bp, Homo sapiens
gatctcttgagcctgga

SEQ ID NO: 30069 - DNA, 17 bp, Homo sapiens
gatctcttgataagaga

SEQ ID NO: 30070 - DNA, 17 bp, Homo sapiens
gatcctgcagttcttct

SEQ ID NO: 30071 - DNA, 17 bp, Homo sapiens
gatcaaactcctgggct

SEQ ID NO: 30072 - DNA, 17 bp, Homo sapiens
gatctggtccaaggcac

SEQ ID NO: 30073 - DNA, 17 bp, Homo sapiens
gatcaaaactacatttg

SEQ ID NO: 30074 - DNA, 17 bp, Homo sapiens
gatcacagtgaggcaaa

SEQ ID NO: 30075 - DNA, 17 bp, Homo sapiens
gatctactaattgttca

SEQ ID NO: 30076 - DNA, 17 bp, Homo sapiens
gatctgaaaacacccac

SEQ ID NO: 30077 - DNA, 17 bp, Homo sapiens
gatcctggaggaatttg

SEQ ID NO: 30078 - DNA, 17 bp, Homo sapiens
gatccctttcatcccaa

SEQ ID NO: 30079 - DNA, 17 bp, Homo sapiens
gatcaaagacaaagaag

SEQ ID NO: 30080 - DNA, 17 bp, Homo sapiens
gatcctccatttcccat

SEQ ID NO: 30081 - DNA, 17 bp, Homo sapiens
gatccaagatttatctc

SEQ ID NO: 30082 - DNA, 17 bp, Homo sapiens
gatctccgagttgattt

SEQ ID NO: 30083 - DNA, 17 bp, Homo sapiens
gatcagacagcagccct

SEQ ID NO: 30084 - DNA, 17 bp, Homo sapiens
gatcaaattatcttgac

SEQ ID NO: 30085 - DNA, 17 bp, Homo sapiens
gatcacgaacccactca

SEQ ID NO: 30086 - DNA, 17 bp, Homo sapiens
gatcctcaactccaaat

SEQ ID NO: 30087 - DNA, 17 bp, Homo sapiens
gatcttgtatcagacac

SEQ ID NO: 30088 - DNA, 17 bp, Homo sapiens
gatctcatgtccatcat

SEQ ID NO: 30089 - DNA, 17 bp, Homo sapiens
gatccaccatctgcttc

SEQ ID NO: 30090 - DNA, 17 bp, Homo sapiens
gatcttactctgtcgcc

SEQ ID NO: 30091 - DNA, 17 bp, Homo sapiens
gatcgtgaacttgcagg

SEQ ID NO: 30092 - DNA, 17 bp, Homo sapiens
gatctttttaaactaat

SEQ ID NO: 30093 - DNA, 17 bp, Homo sapiens
gatccacagagtttcat

SEQ ID NO: 30094 - DNA, 17 bp, Homo sapiens
gatctccttttccttcc

SEQ ID NO: 30095 - DNA, 17 bp, Homo sapiens
gatctatgtctgcagct

SEQ ID NO: 30096 - DNA, 17 bp, Homo sapiens
gatcttgtaatcaggga

SEQ ID NO: 30097 - DNA, 17 bp, Homo sapiens
gatcatatttcttcact

SEQ ID NO: 30098 - DNA, 17 bp, Homo sapiens
gatcctgctcttgaccc

SEQ ID NO: 30099 - DNA, 17 bp, Homo sapiens
gatcccactccaagtct

SEQ ID NO: 30100 - DNA, 17 bp, Homo sapiens
gatcacctttgactgag

SEQ ID NO: 30101 - DNA, 17 bp, Homo sapiens
gatccaggaaaaggaga

SEQ ID NO: 30102 - DNA, 17 bp, Homo sapiens
gatcaaaaaaatgaaac

SEQ ID NO: 30103 - DNA, 17 bp, Homo sapiens
gatcaaaattgactgtg

SEQ ID NO: 30104 - DNA, 17 bp, Homo sapiens
gatctgaatgaccagag

SEQ ID NO: 30105 - DNA, 17 bp, Homo sapiens
gatcaccctgccctccc

SEQ ID NO: 30106 - DNA, 17 bp, Homo sapiens
gatccttgcaacccgtg

SEQ ID NO: 30107 - DNA, 17 bp, Homo sapiens
gatcgcttggaatagca

SEQ ID NO: 30108 - DNA, 17 bp, Homo sapiens
gatcacggaggcgaagc

SEQ ID NO: 30109 - DNA, 17 bp, Homo sapiens
gatccgccgggccacag

SEQ ID NO: 30110 - DNA, 17 bp, Homo sapiens
gatcataatattctata

SEQ ID NO: 30111 - DNA, 17 bp, Homo sapiens
gatcatattttatggta

SEQ ID NO: 30112 - DNA, 17 bp, Homo sapiens
gatcaatctaaaattta

SEQ ID NO: 30113 - DNA, 17 bp, Homo sapiens
gatctctgttactcctc

SEQ ID NO: 30114 - DNA, 17 bp, Homo sapiens
gatctgacactccgggc

SEQ ID NO: 30115 - DNA, 17 bp, Homo sapiens
gatcttttccttttgct

SEQ ID NO: 30116 - DNA, 17 bp, Homo sapiens
gatcacggcgttgtcgc

SEQ ID NO: 30117 - DNA, 17 bp, Homo sapiens
gatcagggatgggagat

SEQ ID NO: 30118 - DNA, 17 bp, Homo sapiens
gatcccactgcccccgc

SEQ ID NO: 30119 - DNA, 17 bp, Homo sapiens
gatctgttactgattgg

SEQ ID NO: 30120 - DNA, 17 bp, Homo sapiens
gatccaagctcagttac

SEQ ID NO: 30121 - DNA, 17 bp, Homo sapiens
gatctgggcggggtggt

SEQ ID NO: 30122 - DNA, 17 bp, Homo sapiens
gatctctaccatggaag

SEQ ID NO: 30123 - DNA, 17 bp, Homo sapiens
gatctggaaaatgcagc

SEQ ID NO: 30124 - DNA, 17 bp, Homo sapiens
gatcagagaccacgaaa

SEQ ID NO: 30125 - DNA, 17 bp, Homo sapiens
gatctcactaaagtgct

SEQ ID NO: 30126 - DNA, 17 bp, Homo sapiens
gatcctgtcaacaacaa

SEQ ID NO: 30127 - DNA, 17 bp, Homo sapiens
gatcagcaaggctcttt

SEQ ID NO: 30128 - DNA, 17 bp, Homo sapiens
gatcagaagtccacatt

SEQ ID NO: 30129 - DNA, 17 bp, Homo sapiens
gatcaaaattttaacct

SEQ ID NO: 30130 - DNA, 17 bp, Homo sapiens
gatcaagccaccaaata

SEQ ID NO: 30131 - DNA, 17 bp, Homo sapiens
gatcagaagaccaagtg

SEQ ID NO: 30132 - DNA, 17 bp, Homo sapiens
gatccccgagcgcatcc

SEQ ID NO: 30133 - DNA, 17 bp, Homo sapiens
gatcaacctgcctcccc

SEQ ID NO: 30134 - DNA, 17 bp, Homo sapiens
gatctttggtttttgct

SEQ ID NO: 30135 - DNA, 17 bp, Homo sapiens
gatctagatgagttttt

SEQ ID NO: 30136 - DNA, 17 bp, Homo sapiens
gatccgtgcgtcaccga

SEQ ID NO: 30137 - DNA, 17 bp, Homo sapiens
gatcccctgaaatacta

SEQ ID NO: 30138 - DNA, 17 bp, Homo sapiens
gatcttaggcattctta

SEQ ID NO: 30139 - DNA, 17 bp, Homo sapiens
gatcgcatttggcttct

SEQ ID NO: 30140 - DNA, 17 bp, Homo sapiens
gatctaattcaaaagtg

SEQ ID NO: 30141 - DNA, 17 bp, Homo sapiens
gatcaagaacttgaatg

SEQ ID NO: 30142 - DNA, 17 bp, Homo sapiens
gatcaagcatcccaatg

SEQ ID NO: 30143 - DNA, 17 bp, Homo sapiens
gatcttactttgattgt

SEQ ID NO: 30144 - DNA, 17 bp, Homo sapiens
gatctatttgccatctc

SEQ ID NO: 30145 - DNA, 17 bp, Homo sapiens
gatccacactgctagtc

SEQ ID NO: 30146 - DNA, 17 bp, Homo sapiens
gatcgtcctgatatagc

SEQ ID NO: 30147 - DNA, 17 bp, Homo sapiens
gatcaagacctatgtaa

SEQ ID NO: 30148 - DNA, 17 bp, Homo sapiens
gatcactgacccccctc

SEQ ID NO: 30149 - DNA, 17 bp, Homo sapiens
gatcccttggttctgat

SEQ ID NO: 30150 - DNA, 17 bp, Homo sapiens
gatcccactctttaagt

SEQ ID NO: 30151 - DNA, 17 bp, Homo sapiens
gatcgccctctgctgct

SEQ ID NO: 30152 - DNA, 17 bp, Homo sapiens
gatccagaagttcacca

SEQ ID NO: 30153 - DNA, 17 bp, Homo sapiens
gatcctgctgctattcc

SEQ ID NO: 30154 - DNA, 17 bp, Homo sapiens
gatctctctctgtctct

SEQ ID NO: 30155 - DNA, 17 bp, Homo sapiens
gatcctctagaagtgcc

SEQ ID NO: 30156 - DNA, 17 bp, Homo sapiens
gatctacagcactgctc

SEQ ID NO: 30157 - DNA, 17 bp, Homo sapiens
gatcattatgtcatgta

SEQ ID NO: 30158 - DNA, 17 bp, Homo sapiens
gatctagcattttattt

SEQ ID NO: 30159 - DNA, 17 bp, Homo sapiens
gatctcctaatcccctt

SEQ ID NO: 30160 - DNA, 17 bp, Homo sapiens
gatcacaagagggacta

SEQ ID NO: 30161 - DNA, 17 bp, Homo sapiens
gatcacaagttgatgac

SEQ ID NO: 30162 - DNA, 17 bp, Homo sapiens
gatcagggaagttgggg

SEQ ID NO: 30163 - DNA, 17 bp, Homo sapiens
gatcaaatgaagcagca

SEQ ID NO: 30164 - DNA, 17 bp, Homo sapiens
gatcccctaagaagtgt

SEQ ID NO: 30165 - DNA, 17 bp, Homo sapiens
gatcatggctgcaggca

SEQ ID NO: 30166 - DNA, 17 bp, Homo sapiens
gatccaaggcctgatgc

SEQ ID NO: 30167 - DNA, 17 bp, Homo sapiens
gatcctgagcaagctca

SEQ ID NO: 30168 - DNA, 17 bp, Homo sapiens
gatcatggtggcagagg

SEQ ID NO: 30169 - DNA, 17 bp, Homo sapiens
gatccaccggatttcgg

SEQ ID NO: 30170 - DNA, 17 bp, Homo sapiens
gatcccaattcatccca

SEQ ID NO: 30171 - DNA, 17 bp, Homo sapiens
gatccaagtattcaagg

SEQ ID NO: 30172 - DNA, 17 bp, Homo sapiens
gatcggctgcttggctt

SEQ ID NO: 30173 - DNA, 17 bp, Homo sapiens
gatcaaagtccacacat

SEQ ID NO: 30174 - DNA, 17 bp, Homo sapiens
gatctatggcaaccctt

SEQ ID NO: 30175 - DNA, 17 bp, Homo sapiens
gatccacaagaagctgg

SEQ ID NO: 30176 - DNA, 17 bp, Homo sapiens
gatctaactggatattt

SEQ ID NO: 30177 - DNA, 17 bp, Homo sapiens
gatctgtttcaaggaga

SEQ ID NO: 30178 - DNA, 17 bp, Homo sapiens
gatccttcacgttgggt

SEQ ID NO: 30179 - DNA, 17 bp, Homo sapiens
gatctttggggagatac

SEQ ID NO: 30180 - DNA, 17 bp, Homo sapiens
gatcaggaacagctttc

SEQ ID NO: 30181 - DNA, 17 bp, Homo sapiens
gatctgggcaacctcgg

SEQ ID NO: 30182 - DNA, 17 bp, Homo sapiens
gatcttgcccacatttg

SEQ ID NO: 30183 - DNA, 17 bp, Homo sapiens
gatcctcttgccacatc

SEQ ID NO: 30184 - DNA, 17 bp, Homo sapiens
gatccacaggcggcagc

SEQ ID NO: 30185 - DNA, 17 bp, Homo sapiens
gatctgagtgaaatgag

SEQ ID NO: 30186 - DNA, 17 bp, Homo sapiens
gatcactttatgtctca

SEQ ID NO: 30187 - DNA, 17 bp, Homo sapiens
gatctgctgttcctggg

SEQ ID NO: 30188 - DNA, 17 bp, Homo sapiens
gatcaaaccccaacctc

SEQ ID NO: 30189 - DNA, 17 bp, Homo sapiens
gatcagccctgagagca

SEQ ID NO: 30190 - DNA, 17 bp, Homo sapiens
gatccttgcagaagcca

SEQ ID NO: 30191 - DNA, 17 bp, Homo sapiens
gatccttctggtactta

SEQ ID NO: 30192 - DNA, 17 bp, Homo sapiens
gatctctgcccacggaa

SEQ ID NO: 30193 - DNA, 17 bp, Homo sapiens
gatctgtggctgtcttc

SEQ ID NO: 30194 - DNA, 17 bp, Homo sapiens
gatctaagcctcccaga

SEQ ID NO: 30195 - DNA, 17 bp, Homo sapiens
gatcaagaacagacgca

SEQ ID NO: 30196 - DNA, 17 bp, Homo sapiens
gatcttgatgtagttct

SEQ ID NO: 30197 - DNA, 17 bp, Homo sapiens
gatctcaagtttcaaca

SEQ ID NO: 30198 - DNA, 17 bp, Homo sapiens
gatcaaacactaaggca

SEQ ID NO: 30199 - DNA, 17 bp, Homo sapiens
gatcagatgttttggga

SEQ ID NO: 30200 - DNA, 17 bp, Homo sapiens
gatccagctattaggat

SEQ ID NO: 30201 - DNA, 17 bp, Homo sapiens
gatctgaagaaattatc

SEQ ID NO: 30202 - DNA, 17 bp, Homo sapiens
gatctaggatacagggc

SEQ ID NO: 30203 - DNA, 17 bp, Homo sapiens
gatcctagtgcgggacc

SEQ ID NO: 30204 - DNA, 17 bp, Homo sapiens
gatcctcatagttaata

SEQ ID NO: 30205 - DNA, 17 bp, Homo sapiens
gatcttcaagcagggag

SEQ ID NO: 30206 - DNA, 17 bp, Homo sapiens
gatctattccacaagac

SEQ ID NO: 30207 - DNA, 17 bp, Homo sapiens
gatctgcccgccgtggc

SEQ ID NO: 30208 - DNA, 17 bp, Homo sapiens
gatctctaacaatgtgt

SEQ ID NO: 30209 - DNA, 17 bp, Homo sapiens
gatctggaaggttcgag

SEQ ID NO: 30210 - DNA, 17 bp, Homo sapiens
gatccgcagctcgaaaa

SEQ ID NO: 30211 - DNA, 17 bp, Homo sapiens
gatcagaacctggaggt

SEQ ID NO: 30212 - DNA, 17 bp, Homo sapiens
gatccaagaagaactag

SEQ ID NO: 30213 - DNA, 17 bp, Homo sapiens
gatctgacatggaaaat

SEQ ID NO: 30214 - DNA, 17 bp, Homo sapiens
gatccgtttagtaagac

SEQ ID NO: 30215 - DNA, 17 bp, Homo sapiens
gatccaagtgtcatccg

SEQ ID NO: 30216 - DNA, 17 bp, Homo sapiens
gatcatagctgaaatac

SEQ ID NO: 30217 - DNA, 17 bp, Homo sapiens
gatcacgttcagaagaa

SEQ ID NO: 30218 - DNA, 17 bp, Homo sapiens
gatctgtgaaaagagaa

SEQ ID NO: 30219 - DNA, 17 bp, Homo sapiens
gatcctttttgaatgtt

SEQ ID NO: 30220 - DNA, 17 bp, Homo sapiens
gatcgtgcaagtggagc

SEQ ID NO: 30221 - DNA, 17 bp, Homo sapiens
gatcctagccagattac

SEQ ID NO: 30222 - DNA, 17 bp, Homo sapiens
gatctcttggttcctgt

SEQ ID NO: 30223 - DNA, 17 bp, Homo sapiens
gatctcatttccaacct

SEQ ID NO: 30224 - DNA, 17 bp, Homo sapiens
gatctttccaaatacaa

SEQ ID NO: 30225 - DNA, 17 bp, Homo sapiens
gatctgttgaaggccca

SEQ ID NO: 30226 - DNA, 17 bp, Homo sapiens
gatctagtaaagctgga

SEQ ID NO: 30227 - DNA, 17 bp, Homo sapiens
gatctcagtgattgtag

SEQ ID NO: 30228 - DNA, 17 bp, Homo sapiens
gatccattctgaattcc

SEQ ID NO: 30229 - DNA, 17 bp, Homo sapiens
gatcccaaaccgccgcc

SEQ ID NO: 30230 - DNA, 17 bp, Homo sapiens
gatcctgagaggtttga

SEQ ID NO: 30231 - DNA, 17 bp, Homo sapiens
gatcccagcagccaata

SEQ ID NO: 30232 - DNA, 17 bp, Homo sapiens
gatctgtggaagaagca

SEQ ID NO: 30233 - DNA, 17 bp, Homo sapiens
gatctctgcatcacatg

SEQ ID NO: 30234 - DNA, 17 bp, Homo sapiens
gatccggagggcgggcc

SEQ ID NO: 30235 - DNA, 17 bp, Homo sapiens
gatcacccatatctgtc

SEQ ID NO: 30236 - DNA, 17 bp, Homo sapiens
gatccaaaaattcatcc

SEQ ID NO: 30237 - DNA, 17 bp, Homo sapiens
gatctgcttgccccaga

SEQ ID NO: 30238 - DNA, 17 bp, Homo sapiens
gatcatcaccctggtca

SEQ ID NO: 30239 - DNA, 17 bp, Homo sapiens
gatccataccatgtcac

SEQ ID NO: 30240 - DNA, 17 bp, Homo sapiens
gatcgagccaagtgaac

SEQ ID NO: 30241 - DNA, 17 bp, Homo sapiens
gatctggctaccccaat

SEQ ID NO: 30242 - DNA, 17 bp, Homo sapiens
gatcagaagccagaggt

SEQ ID NO: 30243 - DNA, 17 bp, Homo sapiens
gatcctctcttccctcc

SEQ ID NO: 30244 - DNA, 17 bp, Homo sapiens
gatcatcttacgatatc

SEQ ID NO: 30245 - DNA, 17 bp, Homo sapiens
gatcacctctcaccttc

SEQ ID NO: 30246 - DNA, 17 bp, Homo sapiens
gatcagagacaaaaaaa

SEQ ID NO: 30247 - DNA, 17 bp, Homo sapiens
gatcgaatttggagaat

SEQ ID NO: 30248 - DNA, 17 bp, Homo sapiens
gatcactcatggcgtcg

SEQ ID NO: 30249 - DNA, 17 bp, Homo sapiens
gatctctgaacttggaa

SEQ ID NO: 30250 - DNA, 17 bp, Homo sapiens
gatcatcctctaccaat

SEQ ID NO: 30251 - DNA, 17 bp, Homo sapiens
gatccctgctcaggggg

SEQ ID NO: 30252 - DNA, 17 bp, Homo sapiens
gatccagcacctgcttt

SEQ ID NO: 30253 - DNA, 17 bp, Homo sapiens
gatcattttttctttaa

SEQ ID NO: 30254 - DNA, 17 bp, Homo sapiens
gatcactcccaagtgta

SEQ ID NO: 30255 - DNA, 17 bp, Homo sapiens
gatcaaattcagaagct

SEQ ID NO: 30256 - DNA, 17 bp, Homo sapiens
gatcctgacacttgaat

SEQ ID NO: 30257 - DNA, 17 bp, Homo sapiens
gatcagaaccaatgtga

SEQ ID NO: 30258 - DNA, 17 bp, Homo sapiens
gatctatcttcagaacg

SEQ ID NO: 30259 - DNA, 17 bp, Homo sapiens
gatctggaaacccagag

SEQ ID NO: 30260 - DNA, 17 bp, Homo sapiens
gatctgctgggatggaa

SEQ ID NO: 30261 - DNA, 17 bp, Homo sapiens
gatcctctcccttttgc

SEQ ID NO: 30262 - DNA, 17 bp, Homo sapiens
gatctcaaagatggacc

SEQ ID NO: 30263 - DNA, 17 bp, Homo sapiens
gatccaccaggccaact

SEQ ID NO: 30264 - DNA, 17 bp, Homo sapiens
gatcatctaaaacaaaa

SEQ ID NO: 30265 - DNA, 17 bp, Homo sapiens
gatcacttttattgagg

SEQ ID NO: 30266 - DNA, 17 bp, Homo sapiens
gatcttcataccacagt

SEQ ID NO: 30267 - DNA, 17 bp, Homo sapiens
gatccgagtccatgagt

SEQ ID NO: 30268 - DNA, 17 bp, Homo sapiens
gatcatttaaaatttga

SEQ ID NO: 30269 - DNA, 17 bp, Homo sapiens
gatcatactcccaaatc

SEQ ID NO: 30270 - DNA, 17 bp, Homo sapiens
gatctaagtggcaatct

SEQ ID NO: 30271 - DNA, 17 bp, Homo sapiens
gatcattatccctggga

SEQ ID NO: 30272 - DNA, 17 bp, Homo sapiens
gatcgctggaatccagg

SEQ ID NO: 30273 - DNA, 17 bp, Homo sapiens
gatccagaaccactttt

SEQ ID NO: 30274 - DNA, 17 bp, Homo sapiens
gatcgtcttctactgca

SEQ ID NO: 30275 - DNA, 17 bp, Homo sapiens
gatcttggtgctaagca

SEQ ID NO: 30276 - DNA, 17 bp, Homo sapiens
gatcctgtgacatcatc

SEQ ID NO: 30277 - DNA, 17 bp, Homo sapiens
gatctgcattttcataa

SEQ ID NO: 30278 - DNA, 17 bp, Homo sapiens
gatcttgccttacaccc

SEQ ID NO: 30279 - DNA, 17 bp, Homo sapiens
gatcttgccttgcaccc

SEQ ID NO: 30280 - DNA, 17 bp, Homo sapiens
gatcacacacaaaatgt

SEQ ID NO: 30281 - DNA, 17 bp, Homo sapiens
gatctggagtctggagc

SEQ ID NO: 30282 - DNA, 17 bp, Homo sapiens
gatcgtattgatattgc

SEQ ID NO: 30283 - DNA, 17 bp, Homo sapiens
gatcagccagaaacaca

SEQ ID NO: 30284 - DNA, 17 bp, Homo sapiens
gatcctggaacctttaa

SEQ ID NO: 30285 - DNA, 17 bp, Homo sapiens
gatcaggattaaatcaa

SEQ ID NO: 30286 - DNA, 17 bp, Homo sapiens
gatcactgaagtggctc

SEQ ID NO: 30287 - DNA, 17 bp, Homo sapiens
gatcacttttcagaaac

SEQ ID NO: 30288 - DNA, 17 bp, Homo sapiens
gatccttgagcgctgca

SEQ ID NO: 30289 - DNA, 17 bp, Homo sapiens
gatcttccaggtgagca

SEQ ID NO: 30290 - DNA, 17 bp, Homo sapiens
gatccagatgtagatta

SEQ ID NO: 30291 - DNA, 17 bp, Homo sapiens
gatcaatggagaggatg

SEQ ID NO: 30292 - DNA, 17 bp, Homo sapiens
gatccagcagaatgggg

SEQ ID NO: 30293 - DNA, 17 bp, Homo sapiens
gatcctaaacaagaaga

SEQ ID NO: 30294 - DNA, 17 bp, Homo sapiens
gatctaaaatataagct

SEQ ID NO: 30295 - DNA, 17 bp, Homo sapiens
gatctcaagcaactggg

SEQ ID NO: 30296 - DNA, 17 bp, Homo sapiens
gatctgagcaatggaaa

SEQ ID NO: 30297 - DNA, 17 bp, Homo sapiens
gatcttcacaggacagt

SEQ ID NO: 30298 - DNA, 17 bp, Homo sapiens
gatccaaaaggttggac

SEQ ID NO: 30299 - DNA, 17 bp, Homo sapiens
gatctgtaagtcgttgt

SEQ ID NO: 30300 - DNA, 17 bp, Homo sapiens
gatcgtgaacttccgag

SEQ ID NO: 30301 - DNA, 17 bp, Homo sapiens
gatcaatatctgtattc

SEQ ID NO: 30302 - DNA, 17 bp, Homo sapiens
gatccttggagcttagc

SEQ ID NO: 30303 - DNA, 17 bp, Homo sapiens
gatccttctcaagctta

SEQ ID NO: 30304 - DNA, 17 bp, Homo sapiens
gatccatatggaaaatc

SEQ ID NO: 30305 - DNA, 17 bp, Homo sapiens
gatcacctaaaacgaag

SEQ ID NO: 30306 - DNA, 17 bp, Homo sapiens
gatccctcaatttggtc

SEQ ID NO: 30307 - DNA, 17 bp, Homo sapiens
gatctgatggttggaaa

SEQ ID NO: 30308 - DNA, 17 bp, Homo sapiens
gatcactggtgttgagc

SEQ ID NO: 30309 - DNA, 17 bp, Homo sapiens
gatcctctagaaactaa

SEQ ID NO: 30310 - DNA, 17 bp, Homo sapiens
gatcttagcccttccca

SEQ ID NO: 30311 - DNA, 17 bp, Homo sapiens
gatcagatttttgccgc

SEQ ID NO: 30312 - DNA, 17 bp, Homo sapiens
gatcccgatgttagaaa

SEQ ID NO: 30313 - DNA, 17 bp, Homo sapiens
gatcacaggaaggttgc

SEQ ID NO: 30314 - DNA, 17 bp, Homo sapiens
gatcgcgtctcatccct

SEQ ID NO: 30315 - DNA, 17 bp, Homo sapiens
gatcctgccgtgagtta

SEQ ID NO: 30316 - DNA, 17 bp, Homo sapiens
gatcagggcacaacctt

SEQ ID NO: 30317 - DNA, 17 bp, Homo sapiens
gatcagtttcatctgga

SEQ ID NO: 30318 - DNA, 17 bp, Homo sapiens
gatcctgatggctctca

SEQ ID NO: 30319 - DNA, 17 bp, Homo sapiens
gatctgcgtgaagacca

SEQ ID NO: 30320 - DNA, 17 bp, Homo sapiens
gatcttatttttgtaag

SEQ ID NO: 30321 - DNA, 17 bp, Homo sapiens
gatccgccggcgctcag

SEQ ID NO: 30322 - DNA, 17 bp, Homo sapiens
gatcagtggatgtagca

SEQ ID NO: 30323 - DNA, 17 bp, Homo sapiens
gatcataccaactgctg

SEQ ID NO: 30324 - DNA, 17 bp, Homo sapiens
gatctggactatgagtc

SEQ ID NO: 30325 - DNA, 17 bp, Homo sapiens
gatcatggcatatccaa

SEQ ID NO: 30326 - DNA, 17 bp, Homo sapiens
gatccaaatcactgaga

SEQ ID NO: 30327 - DNA, 17 bp, Homo sapiens
gatcctgctttacaaaa

SEQ ID NO: 30328 - DNA, 17 bp, Homo sapiens
gatctaaaaactgagct

SEQ ID NO: 30329 - DNA, 17 bp, Homo sapiens
gatctacactgaagttt

SEQ ID NO: 30330 - DNA, 17 bp, Homo sapiens
gatcatcaatgggaagc

SEQ ID NO: 30331 - DNA, 17 bp, Homo sapiens
gatcaaaacttattcac

SEQ ID NO: 30332 - DNA, 17 bp, Homo sapiens
gatctaggcttactgca

SEQ ID NO: 30333 - DNA, 17 bp, Homo sapiens
gatcaccatcaactgtg

SEQ ID NO: 30334 - DNA, 17 bp, Homo sapiens
gatcccaccccaggcct

SEQ ID NO: 30335 - DNA, 17 bp, Homo sapiens
gatctctgccgcctgcg

SEQ ID NO: 30336 - DNA, 17 bp, Homo sapiens
gatccttttattaaggg

SEQ ID NO: 30337 - DNA, 17 bp, Homo sapiens
gatcgtcatctaacaat

SEQ ID NO: 30338 - DNA, 17 bp, Homo sapiens
gatcaagcatgtaaaca

SEQ ID NO: 30339 - DNA, 17 bp, Homo sapiens
gatccatgtagacacga

SEQ ID NO: 30340 - DNA, 17 bp, Homo sapiens
gatctcacatgtatttc

SEQ ID NO: 30341 - DNA, 17 bp, Homo sapiens
gatctctcttcttcatt

SEQ ID NO: 30342 - DNA, 17 bp, Homo sapiens
gatcaaaaagttggtga

SEQ ID NO: 30343 - DNA, 17 bp, Homo sapiens
gatcatagacggactcc

SEQ ID NO: 30344 - DNA, 17 bp, Homo sapiens
gatcttctacgtcgcac

SEQ ID NO: 30345 - DNA, 17 bp, Homo sapiens
gatccacaatgatagca

SEQ ID NO: 30346 - DNA, 17 bp, Homo sapiens
gatcagccaagaaacag

SEQ ID NO: 30347 - DNA, 17 bp, Homo sapiens
gatcctgcgaacgagaa

SEQ ID NO: 30348 - DNA, 17 bp, Homo sapiens
gatcaacccaggcctgg

SEQ ID NO: 30349 - DNA, 17 bp, Homo sapiens
gatcatgaatgaatttg

SEQ ID NO: 30350 - DNA, 17 bp, Homo sapiens
gatcatcgccccctcct

SEQ ID NO: 30351 - DNA, 17 bp, Homo sapiens
gatccaggcttgcttta

SEQ ID NO: 30352 - DNA, 17 bp, Homo sapiens
gatcttttctttttggc

SEQ ID NO: 30353 - DNA, 17 bp, Homo sapiens
gatcactacagggaagg

SEQ ID NO: 30354 - DNA, 17 bp, Homo sapiens
gatccgagcctgtagaa

SEQ ID NO: 30355 - DNA, 17 bp, Homo sapiens
gatccttttaattaact

SEQ ID NO: 30356 - DNA, 17 bp, Homo sapiens
gatctcgtactaccaga

SEQ ID NO: 30357 - DNA, 17 bp, Homo sapiens
gatcagaatgaagacaa

SEQ ID NO: 30358 - DNA, 17 bp, Homo sapiens
gatcttcttctgattct

SEQ ID NO: 30359 - DNA, 17 bp, Homo sapiens
gatccaatgaaaatcca

SEQ ID NO: 30360 - DNA, 17 bp, Homo sapiens
gatcacatcagtgggtt

SEQ ID NO: 30361 - DNA, 17 bp, Homo sapiens
gatccaaaataaaataa

SEQ ID NO: 30362 - DNA, 17 bp, Homo sapiens
gatcctcatagctttat

SEQ ID NO: 30363 - DNA, 17 bp, Homo sapiens
gatcctttaatgtggac

SEQ ID NO: 30364 - DNA, 17 bp, Homo sapiens
gatctgtttgggccaca

SEQ ID NO: 30365 - DNA, 17 bp, Homo sapiens
gatcaaatgccagttgt

SEQ ID NO: 30366 - DNA, 17 bp, Homo sapiens
gatctcctcacaaggga

SEQ ID NO: 30367 - DNA, 17 bp, Homo sapiens
gatccagcaggtgtaca

SEQ ID NO: 30368 - DNA, 17 bp, Homo sapiens
gatctctgctcccagac

SEQ ID NO: 30369 - DNA, 17 bp, Homo sapiens
gatctggctcattcccc

SEQ ID NO: 30370 - DNA, 17 bp, Homo sapiens
gatctgggagcctcttt

SEQ ID NO: 30371 - DNA, 17 bp, Homo sapiens
gatccgattaagtatag

SEQ ID NO: 30372 - DNA, 17 bp, Homo sapiens
gatcatacaacaaggaa

SEQ ID NO: 30373 - DNA, 17 bp, Homo sapiens
gatccagtttgcttcct

SEQ ID NO: 30374 - DNA, 17 bp, Homo sapiens
gatctgcctggccaaca

SEQ ID NO: 30375 - DNA, 17 bp, Homo sapiens
gatcacaaatgatttag

SEQ ID NO: 30376 - DNA, 17 bp, Homo sapiens
gatcagatgaaatgcct

SEQ ID NO: 30377 - DNA, 17 bp, Homo sapiens
gatctgtgggtccaaac

SEQ ID NO: 30378 - DNA, 17 bp, Homo sapiens
gatctcaatcctgaatc

SEQ ID NO: 30379 - DNA, 17 bp, Homo sapiens
gatccttgcaaaatacc

SEQ ID NO: 30380 - DNA, 17 bp, Homo sapiens
gatcatcctagccgact

SEQ ID NO: 30381 - DNA, 17 bp, Homo sapiens
gatcatctcagcaacct

SEQ ID NO: 30382 - DNA, 17 bp, Homo sapiens
gatccaaaatacgttgc

SEQ ID NO: 30383 - DNA, 17 bp, Homo sapiens
gatcgagtcacaaaaat

SEQ ID NO: 30384 - DNA, 17 bp, Homo sapiens
gatctgcgccatgccgt

SEQ ID NO: 30385 - DNA, 17 bp, Homo sapiens
gatctgaagaaggcaca

SEQ ID NO: 30386 - DNA, 17 bp, Homo sapiens
gatcaggctgcttgagg

SEQ ID NO: 30387 - DNA, 17 bp, Homo sapiens
gatcgctccatccgggg

SEQ ID NO: 30388 - DNA, 17 bp, Homo sapiens
gatcctgtcctagagaa

SEQ ID NO: 30389 - DNA, 17 bp, Homo sapiens
gatctactcctttaagc

SEQ ID NO: 30390 - DNA, 17 bp, Homo sapiens
gatctcatgtatgccaa

SEQ ID NO: 30391 - DNA, 17 bp, Homo sapiens
gatcccaaacaccaaga

SEQ ID NO: 30392 - DNA, 17 bp, Homo sapiens
gatcttgctttgtgggc

SEQ ID NO: 30393 - DNA, 17 bp, Homo sapiens
gatcaggggcccccagg

SEQ ID NO: 30394 - DNA, 17 bp, Homo sapiens
gatcctgagcaaggagg

SEQ ID NO: 30395 - DNA, 17 bp, Homo sapiens
gatcctggattgtgaaa

SEQ ID NO: 30396 - DNA, 17 bp, Homo sapiens
gatctcgctgtactcca

SEQ ID NO: 30397 - DNA, 17 bp, Homo sapiens
gatcttcgtggaagact

SEQ ID NO: 30398 - DNA, 17 bp, Homo sapiens
gatcaaaacagaactta

SEQ ID NO: 30399 - DNA, 17 bp, Homo sapiens
gatcgtccagaagtctc

SEQ ID NO: 30400 - DNA, 17 bp, Homo sapiens
gatcatcaagtgtgcat

SEQ ID NO: 30401 - DNA, 17 bp, Homo sapiens
gatctgagtggaagcaa

SEQ ID NO: 30402 - DNA, 17 bp, Homo sapiens
gatctacagcatcagaa

SEQ ID NO: 30403 - DNA, 17 bp, Homo sapiens
gatctgagagacttaca

SEQ ID NO: 30404 - DNA, 17 bp, Homo sapiens
gatccttgccctcacag

SEQ ID NO: 30405 - DNA, 17 bp, Homo sapiens
gatctgcctgctttcac

SEQ ID NO: 30406 - DNA, 17 bp, Homo sapiens
gatcaggatggggagtc

SEQ ID NO: 30407 - DNA, 17 bp, Homo sapiens
gatcctggctcctgctc

SEQ ID NO: 30408 - DNA, 17 bp, Homo sapiens
gatcctgattgaaaaac

SEQ ID NO: 30409 - DNA, 17 bp, Homo sapiens
gatccttcctgaggatg

SEQ ID NO: 30410 - DNA, 17 bp, Homo sapiens
gatcgagaagtaaacaa

SEQ ID NO: 30411 - DNA, 17 bp, Homo sapiens
gatccaaagacaatggg

SEQ ID NO: 30412 - DNA, 17 bp, Homo sapiens
gatctgctcggccgccc

SEQ ID NO: 30413 - DNA, 17 bp, Homo sapiens
gatctcacggaggtcat

SEQ ID NO: 30414 - DNA, 17 bp, Homo sapiens
gatctcaccagcggggt

SEQ ID NO: 30415 - DNA, 17 bp, Homo sapiens
gatccaactttactaaa

SEQ ID NO: 30416 - DNA, 17 bp, Homo sapiens
gatctgattttgacttt

SEQ ID NO: 30417 - DNA, 17 bp, Homo sapiens
gatctacttggcaggaa

SEQ ID NO: 30418 - DNA, 17 bp, Homo sapiens
gatcatatttcacccac

SEQ ID NO: 30419 - DNA, 17 bp, Homo sapiens
gatcctgtgaccagcaa

SEQ ID NO: 30420 - DNA, 17 bp, Homo sapiens
gatcctgtcccggcgca

SEQ ID NO: 30421 - DNA, 17 bp, Homo sapiens
gatctgcgcctgggggt

SEQ ID NO: 30422 - DNA, 17 bp, Homo sapiens
gatctctactccccctg

SEQ ID NO: 30423 - DNA, 17 bp, Homo sapiens
gatcccagtctcggtgc

SEQ ID NO: 30424 - DNA, 17 bp, Homo sapiens
gatccgagaaggcaacc

SEQ ID NO: 30425 - DNA, 17 bp, Homo sapiens
gatctatttgctttttt

SEQ ID NO: 30426 - DNA, 17 bp, Homo sapiens
gatctgatgtttcacgc

SEQ ID NO: 30427 - DNA, 17 bp, Homo sapiens
gatcctgctatatcaac

SEQ ID NO: 30428 - DNA, 17 bp, Homo sapiens
gatcactatattccttg

SEQ ID NO: 30429 - DNA, 17 bp, Homo sapiens
gatcataaaatggcttc

SEQ ID NO: 30430 - DNA, 17 bp, Homo sapiens
gatctgtcatgtgccac

SEQ ID NO: 30431 - DNA, 17 bp, Homo sapiens
gatccagatacacctcc

SEQ ID NO: 30432 - DNA, 17 bp, Homo sapiens
gatcaaagacaatggct

SEQ ID NO: 30433 - DNA, 17 bp, Homo sapiens
gatctgtcctcttcgtg

SEQ ID NO: 30434 - DNA, 17 bp, Homo sapiens
gatcctggaacgtgctc

SEQ ID NO: 30435 - DNA, 17 bp, Homo sapiens
gatccaaaagatttgaa

SEQ ID NO: 30436 - DNA, 17 bp, Homo sapiens
gatctgtgattcttgac

SEQ ID NO: 30437 - DNA, 17 bp, Homo sapiens
gatccattctcctgggc

SEQ ID NO: 30438 - DNA, 17 bp, Homo sapiens
gatccaagaaatgaagc

SEQ ID NO: 30439 - DNA, 17 bp, Homo sapiens
gatctcatcaccataat

SEQ ID NO: 30440 - DNA, 17 bp, Homo sapiens
gatccatcacctacatc

SEQ ID NO: 30441 - DNA, 17 bp, Homo sapiens
gatcactctttttatct

SEQ ID NO: 30442 - DNA, 17 bp, Homo sapiens
gatcagttccccagaga

SEQ ID NO: 30443 - DNA, 17 bp, Homo sapiens
gatcgtgtcgctgcggt

SEQ ID NO: 30444 - DNA, 17 bp, Homo sapiens
gatccaaacaggatgct

SEQ ID NO: 30445 - DNA, 17 bp, Homo sapiens
gatcacagcacacacat

SEQ ID NO: 30446 - DNA, 17 bp, Homo sapiens
gatcccaggacaggaac

SEQ ID NO: 30447 - DNA, 17 bp, Homo sapiens
gatctccctcctcctca

SEQ ID NO: 30448 - DNA, 17 bp, Homo sapiens
gatcgagcaaggagaag

SEQ ID NO: 30449 - DNA, 17 bp, Homo sapiens
gatcttgccagacgaaa

SEQ ID NO: 30450 - DNA, 17 bp, Homo sapiens
gatcccactgccagaga

SEQ ID NO: 30451 - DNA, 17 bp, Homo sapiens
gatccacattgcacagc

SEQ ID NO: 30452 - DNA, 17 bp, Homo sapiens
gatcaaggttttctgga

SEQ ID NO: 30453 - DNA, 17 bp, Homo sapiens
gatctttgttttgtatt

SEQ ID NO: 30454 - DNA, 17 bp, Homo sapiens
gatctctttaatctcaa

SEQ ID NO: 30455 - DNA, 17 bp, Homo sapiens
gatctcttggctggagg

SEQ ID NO: 30456 - DNA, 17 bp, Homo sapiens
gatcacctgctggatgg

SEQ ID NO: 30457 - DNA, 17 bp, Homo sapiens
gatcacatcattcacac

SEQ ID NO: 30458 - DNA, 17 bp, Homo sapiens
gatcaactctccacctc

SEQ ID NO: 30459 - DNA, 17 bp, Homo sapiens
gatcaacaacataataa

SEQ ID NO: 30460 - DNA, 17 bp, Homo sapiens
gatcttatggcggtggc

SEQ ID NO: 30461 - DNA, 17 bp, Homo sapiens
gatctagggcagggagg

SEQ ID NO: 30462 - DNA, 17 bp, Homo sapiens
gatcagtgtttgagtac

SEQ ID NO: 30463 - DNA, 17 bp, Homo sapiens
gatcatataacccccgt

SEQ ID NO: 30464 - DNA, 17 bp, Homo sapiens
gatcgaatagaagactt

SEQ ID NO: 30465 - DNA, 17 bp, Homo sapiens
gatctgcataaagtatt

SEQ ID NO: 30466 - DNA, 17 bp, Homo sapiens
gatcatggtggcgttgc

SEQ ID NO: 30467 - DNA, 7319 bp, Homo sapiens
cccgtccccggcgcggcccgcgcgctcctccgccgcctctcgcctgcgccatggccggccggtcccacccgggcccgctgcggccgctgctgccgctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaacttt

SEQ ID NO: 30468 - DNA, 5616 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactacc

SEQ ID NO: 30469 - DNA, 2486 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgacttaaaaaaaaaaaaaaaa

SEQ ID NO: 30470 - DNA, 2059 bp, Homo sapiens
agtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaactaaaaaaaaaaaaaaa

SEQ ID NO: 30471 - DNA, 2381 bp, Homo sapiens
ggtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacacagacctgggaaaacgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcaagcccctgaccccgagaagctggaaattgactgctgggcagggaaacctatttctggagacctttacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctaaaaaaaaaaaaaaaaaaaaa

SEQ ID NO: 30472 - DNA, 2662 bp, Homo sapiens
aagtaggcggagaaagcagaggaggaccggcgggccaagctttcctagcctgacagcagccatttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgaattcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaacaattagctttttctttaggactgacctgttaggggataaacatcacaataatctgaattccaagttattttgtattttgtttttaataaatacaacctgatttaag

SEQ ID NO: 30473 - DNA, 7603 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 30474 - DNA, 7816 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcagggccgtgcaggcctgcccagctgccagcggtggcccccatagctgcctcctcccaccctcactcatccgtgatcacttcacctctgcgtgccctgggcgctctcccgccctgcctccccctgccgtgctgcagcgcgcgcccggtctcgggtgacgggactcagggtgagggtcagacggaggctccctttggatgccagtgtcagttgtcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 30475 - DNA, 11386 bp, Homo sapiens
gtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcacatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacattttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctgttgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtctcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagcagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattggcactgatt

SEQ ID NO: 30476 - DNA, 2307 bp, Homo sapiens
aactaaactataagaggtaagcagttctcagaggagacagaaggcaacagctctaccatcctccaaacatctgaagccccccatagaaactcctcttggaattggtggttccctgtctgacccaaatgctaggccgatttcaacccttctccttggtccggagtttcagactgggatttgaagcctgctgctatccaaaccaaaaatgtgctactcagaccatcagaccccctgactccaggtgcctagtccaagcagtttctcagaactttaattttgcaaaggatgtgttggatcagtggtcccagctggaaaaggacggactcagagggccttaccccgccctctggaaggttagtgccaaaggagaagaggacaaatggagctttgaaaggatgactcaactctccaagaaggccgccagcatcctctcagacacctgtgcccttagccatggagaccggctgatgataatcttgcccccaacacctgaagcctactggatctgcctggcctgtgaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagggtctactccgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtaagaaaattttcttctttcctaaatactttcattgttgctactaatcgtagtgccattattgttgagtactttatgatttgccaaatacttttgtcccaatttttaattttgcaaatttttgagtctccaaaaatgttaaatagtagcactcacctacattcacttcttattaagattttgccccatttacttcatatttgcacatttttgatgaggcatttgggagtaaatgcagacattatgacactttgtccttaaatatttcagcagcatcctcctaataaggactttcttcttaaacatcagcaccatcacatctatgaaaattaaaaataattatttaatactatctaatatctagccaatacttagactttctcaattgtactcagatgtgttttataccttttgtaaatccagaattcaatcaaagttcatgcatttatttggttctcatatctctttagttgtttttatctataactgttccaccaccatgtttttcgtgacgtggacattttgaagaatagaggacggttgtgttaaaaaatgcctcactttctaggcttacatattgtttctttataatgagatccaggataaacatctttctcaagactattatgtagatgatgtatatttcttatttgcttatggggggaaacattaggttgtctcattttggatgctgatcattttgatcttttgattaaggaggtgagtgccatttccattgtaaaggtacattttcctctttgtaattagtaataatctgccgtgtaacaatttgagactctgtaaatatcctattctccaattaactttcacccaatcattttagcatccatagatgattcttttctttttggaaacaattattaaaataaagagtggctgggcacagtggctcatgcctgtaatctcaacactttgggaagctaagatggacagatcacttgagcccaggggttcaagactagcctgggcaacatggcaaaactccatctctac

SEQ ID NO: 30477 - DNA, 1583 bp, Homo sapiens
acaaagcaggcagacttgcccacagaacccacagccttcccctcgatttgtcctcttgctccttcctgctaggacagcagggcttctcgtacacatgctgtagcgggcactgccttggcaggagggtttggggcttccacatatcctgttctcaagattgtagcatctcagtactctagagcccagtacctgacatcaaggatgtctggagcttccttttaaggaaagaaaagatcagcaaacttgcctgttcccgtttacacttccaccaccagttcgtgagagttcctgttctgcatcctcaacactagtattaagtgagagttcctgttctgcatcctcaacgctagtattaagtgcactggcctttagtctgttaaaaagcatacaatggctacagatgttcaattggctggttatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggccttcctccttcaggatcaggagctgctggtcctggagctcctgtgtcagatcctggaaacagacttgctaagcgcaatccagttctggctgctctacgctccgcccaaggaaaaagacctcgctctgggactcctgcagacagcagtggctcagctccttccccagcccctagtctccatccctacagaaaagctcctaagccagcttccagaagtgcatgaacctcctcaagagaagcaagagccaccctgcagtcaatccccgaagaaaacgaagatatcaccttttacaaaaagcgaaaaaccagagtacattggagaagctcaagtcctccagatgcattcaagccagaacacagagaagaagacatcgaagccgagggcagagagctgaggggccctaacacttgcacctgccttgctcaagagcagccccaagggttcaggggtgtttctgtctccaccaccttcacagcagtacctgattccctaccgtgaaaactcttactaaataaaaccgtcttccctgag

SEQ ID NO: 30478 - DNA, 3088 bp, Homo sapiens
cgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgccccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgtcaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgaaaaaaaaaaaaaaaaaaaa

SEQ ID NO: 30479 - DNA, 3606 bp, Homo sapiens
aaaggtgactagagtgctaagccagtcaacagggaaaacttggctcctgactttgggtctttcttctcagtctatatggaagaaaactgagaaaaaatataaaaaagaagaacacaactagttgcgcatctcctaaagagatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgctaagtgtgttcacatcaggaggacttgctcccagcttgggaatcatgaatagtacatataatggcatcttccactttaatttaacgttgttcagtgatcggattttgtggttggttgatattcctagagaaaacatcacacaaagcacagatattgcagctgtagaagaatggttagtaagaatcactttacatcatggactaaatatttatgctactgaaggaactctattggatgttattcgagaaccgattcttcagtggactcctggggatgtgattccagaaagtgaaatcagtaaattatatccacatgtggtagatctcaaagtgacaaaatgcccctgtgccaatgatgtggcattactaggcttcattgtggatacaatagttgatggtgtttacataggcataacctttggtggattctggcatgattatgataccacatggtttaacatgacacagactatctattcccaacttcaagaagaatatgaagacctttcattggtggatatggttttaacgaatcattttttagttatcctcacctctttgggcctttttgtaagtgaagatcttcgttatccatcacgccacagcttatcgttttccagggcagacttttgtggttttgaaagggttgactatgtgaaaggaaaactgtggtataatgaaagatgttttgctaacagagagcactttgaagttgattatgttacagttacctttgagagaaacagaaccctaagtgagtcaagctcttgtttttatagtcaggaaccatttcttgaatgggtaccctgcttacctcacatttttaaaggaataaaaatttttccaactgtgctaacatttcttgttgaccaagagcgtggtactggagtttacctcttctataacaaggtcaggaaaactgccattgcctctgtgagcaccctgagaaataatgaaccaaattcacaatcaaaatttccaatttttcggtttccttcatcattctcttctcccgttggaatggtatttcatccccgaagccactttttgtatgcttatggcaatcagatatggctttcagttgatggcggcaacacctttcaattaatagctaactttcatgatgatatcataaagaagacttttcatagtttttatacatcagctattacttttgtttctcaacgtggaaaggtttactcgacaaaggcaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacattgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtcacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtgaacacatggtgatcataatttctctttattttctagttttatcagccaattcctagaacaatatatttaaatgttaaatatgcaagctacataaaatcctaaagaattgtcattat

SEQ ID NO: 30480 - DNA, 3246 bp, Homo sapiens
tgcggtgcctgcgcccgcggcggcggaggcgcaggcggtggcgagtggatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaatgccatcagctcacacttgcaaacctgtggctgttccgttgtagtaggtagcagtgcagagaaagtaaataagatagtcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaacatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatttgaaattttaaaaaaaaaaaaaaaaaa

SEQ ID NO: 30481 - DNA, 615 bp, Homo sapiens
gctcagagagaagtgactttgagctcacagtgtcaccgcctgctgatgggagagctgaattcaaaaccagggtgtctccctgagcagagggacctgcacacagagactccctcctgggctcctggcaccatggccccactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgttggtgttcaccgcccccaccctgagcgcctgggtccaggggaggccttccagggacgaagaagagccacagtgagggagatcccatccccttgtctgaactggagccatgggcacaaagggcccagattaaagtctttatcctc

SEQ ID NO: 30482 - DNA, 2101 bp, Homo sapiens
acgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaaaaaaaaa

SEQ ID NO: 30483 - DNA, 2072 bp, Homo sapiens
gggcagtcgtaggagactctgaaaaagcaaataaatcaatgttaaatcagaaatgtgaatgtagtaaggggctgaagagacaggggaagagaatacatgggaaaatattgaaaaggacagagtgatcaaaaaaagcagggacatgggagcattgggcagcacactgggagccatttactttatgctcttattgtatgattgagaaaaaaaatgtccttagtggttaagtggcttttcaatgccacatcagacttgttccatagcagttgaattaggggaaggtgaataagttggaggttggtgacaaggagagaagctggaacagagaggagagtcagaaccagagggaaatgagagactgagtaggcatctcagggtttttgaaggagtggattttctttgttgcagtcaggggaggtttgtctgttggctgcagaaagaagtcagaatagagatatcgtggggtaggtttgtttggaacagaaatcaaagaccaatttttctgagagaaggaaataacatctgcaaatgatatgctgtttttgctacttccattgttagctgttctcccaggtgatggcaatgcagacgggctcaaggagcctctctccttccatgtcatctggatcgcatccttttacaaccattcctggaaacaaaatctggtctcaggttggctgagtgatttgcagactcatacctgggacagcaattccagcaccatcgttttcctgtggccctggtccaggggaaacttcagcaatgaggagtggaaggaactggaaacattattccgtatacgcaccattcggtcatttgagggaattcgtagatacgcccatgaattgcagtttgaatatccttttgagatacaggtgacaggaggctgtgagctgcactctggaaaggtctcaggaagcttcttgcagttagcttatcaaggatcagactttgtgagcttccagaacaattcatggttgccatatccagtggctgggaatatggccaagcatttctgcaaagtgctcaatcagaatcagcatgaaaatgacataacacacaatcttctcagtgacacctgcccacgtttcatcttgggtcttcttgatgcaggaaaggcacatctccagcggcaagtgaagcccgaggcctggctgtcccatggccccagtcctggccctggccatctgcagcttgtgtgccatgtctcaggattctacccaaagcccgtgtgggtgatgtggatgcggggtgagcaggagcagcagggcactcagcgaggggacatcttgcccagtgctgatgggacatggtatctccgcgcaaccctggaggtggccgctggggaggcagctgacctgtcctgtcgggtgaagcacagcagtctagagggccaggacatcgtcctctactgggagcatcacagttccgtgggcttcatcatcttggcggtgatagtgcctttacttcttctgataggtcttgcgctttggttcaggaaacgctgtttctgttaagacacaccatgagcctcctcgtcacccttctccttttggggtgagagaccagcagcccaagggctccagacacacctgaacacatcgtgatgatgacgtcctctcaactctctttgtaaaaattttgttatttttgcttgtttctgattaatgattgtttgtcaatataagctcaatttaattttgcaggatttgttgttctgacctgggttctgggacttttaaattcaaattttatctccagatggaatggggtcctagcaacctccacatgttcacctattaatggatcatcaggcctgttttagatatcccttactccagagggccttccctgacttacaagtgggaagcagtctcttcctggtctgaactcccgccacattttagccgtactttgctaactgtgctcctcacttcctcttcttcattgcagttatttagatcccccctttccttctaatttttcagctccttcaatgcaaagtacatgtatttttaatatatgcatccctggtgaaggatcttgcctgcatgaaacatgttctcaataaa

SEQ ID NO: 30484 - DNA, 1295 bp, Homo sapiens
atcaaataccagctctgccagtaagaagttgcatctcccagtgaaatgctgctgctgccatttcaactgttagctgttctctttcctggtggtaacagtgaacatgccttccaggggccgacctcctttcatgttatccagacctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaagtgaagcctgaggcctggctgtccagtggccccagtcctggacctggccgtctgcagcttgtgtgccatgtctcaggattctacccaaagcccgtgtgggtgatgtggatgcggggtgagcaggagcagcagggcactcagctaggggacatcctgcccaatgctaactggacatggtatctccgagcaaccctggatgtggcagatggggaggcggctggcctgtcctgtcgggtgaagcacagcagtttagagggccaggacatcatcctctactggagaaaccccacctccattggctcaattgttttggcaataatagtgccttccttgctccttttgctatgccttgcattatggtatatgaggcgccggtcatatcagaatatcccatgagccatcatcatgtctcctctcccattcgcaataagctaccaagaagcccaagatatcagcccaaaaatcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaat

SEQ ID NO: 30485 - DNA, 1207 bp, Homo sapiens
acagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactggggacaccactcttccatgaattggattgccttggtagtgatagtgcccttggtgattctaatagtccttgtgttatggtttaagaagcactgctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaaaaaaaaaaaaaaa

SEQ ID NO: 30486 - DNA, 2329 bp, Homo sapiens
gttttctacccaagaatgctacttcaggagatcagtcaaaaggttagggtgatggtgacggtggaaatatagaaaaaggaatttattcaagaggtattcaaaaagaagtgaaatagagatgagttggagatagattggataaaaagagtgagggagagggaggtgtcaggctgcagcccaggttctgagttgccaaagaggagtcttttcctccaggaaattgagacacgccggttgtgaaacctactgaagtgagcggcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggccattcaagtgctcaaccaggacaagtggacgagggaaacagtgcagtggctccttaatggcacctgcccccaatttgtcagtggcctccttgagtcagggaagtcggaactgaagaagcaagtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactggggtgggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcccaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaacgaagataaatcataaaaaaaaaaaaaaaaaaaaaaaaaaaaaaaaaaaaaaaaaaaaaaaaaaaaaaaaaaaaaaaaaaaaaaaaaaaaa

SEQ ID NO: 30487 - DNA, 972 bp, Homo sapiens
atgctgctcctgttcctcctcttcgagggtctctgctgtcctggggaaaatacagcagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagaggtga

SEQ ID NO: 30488 - DNA, 1585 bp, Homo sapiens
gatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcagcaggtgcctgggcttcttaaggctcctgggcaaggcgtgggagttgtcctgacttgcttgggatctcgccctcctacctacctgtttcttccttcatctcctcccacctcagcttctcaagtagctctggcactacagacatgtgccactatgcctgaatatttttatttttgtgtagacacgggatctcactatgttgcctaggctggtcttggactcctgtactgaagcgatcctcccaccttgacctcccaaagtgctgggactataggtgtgagccactgtaccaggctatatatggtattaaaattttttaaatttccaattgtttattactagtatataaaaatacaattaatttttgaatattaatcaaaacaaaaagcaaaactgctacactcacttattaattctagtaactttttgtaagaccgttgagtattctacatagacaatcatgttgtctgtgaacaaaaacagtttgttttctttcctatctgggtgctttttgtttctgtttcttggcttattgcactggctagaacctccagtacaatgttgaatagaagtggagagaggacatccttgtcttgttcatgatcttaggaggaaagcattgtctttcatctttaagtacattagctgtgggtttttcttagatgtcctttaacagattgagctagttcttttctttctagtttgctgagaatttttatcaaaaatagatgttgggtctcgtcaagtgcttaccctgcatccattgagatgataatatggttttacttttttagtctgttaatatggtacattacattgatggcacgatatgttaaaccaacctttcattcctgaaaaaaactctagtcatttggtattattcttttgatatgttattagattaaatttattaaaattttgttaagaaaaaaaaaaaaaaaaaaaaaaaaaaaaaaaaaaaaaaaaaaaaaaaaaaaaaaaaa

SEQ ID NO: 30489 - DNA, 822 bp, Homo sapiens
gggctgctccacgcttttgccggagacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgt

SEQ ID NO: 30490 - DNA, 1040 bp, Homo sapiens
cgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtg

SEQ ID NO: 30491 - DNA, 2261 bp, Homo sapiens
gaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 30492 - DNA, 2150 bp, Homo sapiens
gaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 30493 - DNA, 1938 bp, Homo sapiens
gatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttaggctccgtccccaaaaaaaaaaaaaaaaaaaaaaaaaaaaa

SEQ ID NO: 30494 - DNA, 4379 bp, Homo sapiens
gacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcaggtaaagaaaaggggtccatctttcatgacttctccttcacctaagcacctcaaaacagatgatagcacttcaggattgacgcgaagcatcttcaaatatttggagagctaacaccatcaaaggtgccaaaatctacattgagactgctttgagaagtttctagcactgaaagttggaattgacactccagccaatgatccttccttctttcataatcaatgcaataagattgcagacagaaattccagtgatttctactgcacagctctggacatctcttttcctagtattattccctgaattggccactgatttcaattctgcagtatttacaacatcaacaactcatggaatacttgggtgaggtttcctttttttttttttttttaa

SEQ ID NO: 30495 - DNA, 456 bp, Homo sapiens
ttttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttc

SEQ ID NO: 30496 - DNA, 2295 bp, Homo sapiens
aagaacccggaagtggtggagccaacggccagccagacctgtggcagtcccagccccagggtgctctccgcggtcggccatttatcggtgaagcaacagccccttgacgtcaagcttgacgcattggagataaagtccaaggaggtgaactaacctttgaacgtgccactggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 30497 - DNA, 2292 bp, Homo sapiens
ggcaggattcgcgcctccatttttccaggagagagcgggataccaagagaaccggaccagctggtactgggacacggggagagtagctggtgcggtcggctggggcatttagagaaaaccacagaaacgactggggcgagactggaagagtcgagagttagcaagctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 30498 - DNA, 2323 bp, Homo sapiens
aactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 30499 - DNA, 1496 bp, Homo sapiens
gctctaagcgcccggggccccgcccagtggccggcacagccaatcgcagcgcgggaaggcggtgggggcggggaaggccgcctggaaacttaaatcccgaggcgggcgaacctgcaccagaccgcggacgtctgtaatctcagaggcttgtttgctgagggtgcctgcgcagctgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaa

SEQ ID NO: 30500 - DNA, 2068 bp, Homo sapiens
acactttggcaggaagctgttgccagggcagcacctgtgaagccctggcctggcttcagagtctgctggtgagatgacatcaaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctaggaaagtgttgtcaacatttttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaacaaaaaaaaaaaaaaaaaaaaaaaaaaaaaaaaa

SEQ ID NO: 30501 - DNA, 2071 bp, Homo sapiens
acactttggcaggaagctgttgccagggcagcacctgtgaagccctggcctggcttcagagtctgctggtgagatgacatcaaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctaggaaagtgttgtcaacatttttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaacaaaaaaaaaaaaaaaaaaaaaaaaaaaaaaaaa

SEQ ID NO: 30502 - DNA, 2584 bp, Homo sapiens
aatcttggggcaggggccattttggaagcatgttgcgaggctccgcttcttctacaagtatggagaaggcaaaaggcaaggagtggacctccacagagaagtcgagggaagaggatcagcaggcttctaatcaaccaaattcaattgctttgccaggaacatcagcaaagagaaccaaagaaaaaatgtctgtcaaaggcagtaaagtgctctgccctaagaaaaaggcagagcacactgacaaccccagacctcagaagaagataccaatccctccattaccttctaaactgccacctgttaatctgattcaccgggacattctgcgggcctggtgccaacaattgaagctgagctccaaaggccagaaattggatgcatataagcgcctgtgtgcctttgcctacccaaatcaaaaggattttcctagcacagcaaaagaggccaaaatccggaaatcattgcaaaaaaaattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgttgcccaggctggagtgcagtggtgcaatctcagttcagtgcaatctccgcctcctgggttcaaatgattctcctgcctcagcctcttgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtgatttttcttttgtatgactcgtttgttctttattagttggtggtatgggttggatcatttgtttttaaaactacttaggtatgattcacatacaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagatgttcttctctcctgcccgcccccgccgttggttgttggtggtcagaattattgtgtaataaataatagacattttttcttataaaaaa

SEQ ID NO: 30503 - DNA, 2751 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccagta

SEQ ID NO: 30504 - DNA, 2281 bp, Homo sapiens
acaactggcctgaccttcaaaggccttcacagctcctgccttcatgttaccgtctactatgttcctcgtgcaccttccactcagcacaaacaggctgcactgcctccgaaacacatcacttgaatcctacctctgctcctttgtccatctgaatcaccctctccacatttctgaccgtgtaatcctgatctcacttcatgaggcagttcgcttctcttttgcatttagctttccccggggtacactgtcaatagcctactgtctgatgtcatcagtcagcacttcatcagaggcaattatgtccacagagcttttggctaattactgtcactcctctttacatgtgtgcatatgcatatcatctttccctaatgagactggaaatcatgattcattccctggagcagtggtttccataagtgaccaacccacagaccagtgcaaactggctgcaaaagagcttcctctgaggaacttattagaatgcagattctttgactgcatgggagaggaggatctcataaatctgggtgtaataggcacagaacgttaggtgtaatatgggcgggactctggactcagcatatccaacaagctgctggctgattccgacgatgccgatgaattgccaggttgggaactgctgcccccagagaacctagcagagagctctgtacgtggtaggtgctcactcccctattgtttgggtgtatgcctcctgataatgaacttgatcgtaactttattgttgtattatgcctgtattgtttccttaagtgaaggaagaatgcttttgagtacctaataggtggcaagctctgtgcctacttacatacatgaactattccttttaataacctttggaaataaagtggcatttccattgggcattagaaatctgaagactttcgtttacagctgttgcaacagcagaactagaattcgacctccgacatttctgctcaccagagggcatgaactgctggtttgtacctggcttgcagataccttctttgggcagcacaatgttcaaaattaaaaaaactaccaacacttctaaactggatactttgtatcaatatctgggtttctggcttctcttcacgggaaaaaaacaaacaaacaaaaaggtttggtgaacactggggcccacattcctgcagggcaacagtcacatggagactttagatgggcacgtgcccagaacacactagagtccccatcgctccccattctcttacattctgttcccaactaggttcttataggcctgggtttgtgcctgttgcacacttatctactctcttgcttcccactggtcaggaagtctggcaaacttaaaaggcctctttttgttgctctcttctgtatggatctctcatcatagaggtgtgtgcatttctgactttgtgatttcaatactaaggaagctgtcggcagattatcaaggaaaacggggatcgctgctccccaacgtacacattctggtgtgccccagtaaaattctatattcagcctccaaactagctgggaaaaatgtggcaaatcatctacttgctccaattcaatggtgtttagaagtaggaagtcactgtgagcaatgccaccaagtggtggagagactccatgcagaatcgccaccttcagccagagaggctgggaggccgaagacctctctcaatgcacagggccattcagaaactagaaacaaaatgcttgctcatctccctaggccactccttccgaggctttttgagacggggtctcactgtcacccaggccggagtgcagtggcacaatcaaggctcactgcagcctcaaccttctgggttcaagcgatcctcccacttcagcctttcaagtggctgggatgactacaggcatgggccaccacagccagctgattttttttttctttttagtagaaatgaggtctcgccatgttgctcagactggtcttgaaccaacacatctttagctttttaaaagacagccttggccagccatggcagctcacacttgtaatcactgcactttcggaagctgaggtgggcagatagcttgagccgaggagttcgagaccagcctgggcaacgtggtgaaaccccatctctacaaaaaatacaaaaattagctgggtgtgatggtgcacatctgtggtcccagctgctggggaggctgaggtgggaggattgcttgggcctgggaggtcgaggctgcagtgagctgtgattacctcactgcattccagcctgggcaacagagaaccctgtctctattt

SEQ ID NO: 30505 - DNA, 2385 bp, Homo sapiens
tacataaaataaataaatacataaataaaatagatatgtatttatgcaaaccatagaaaaatgtttggcaaccatcgcaagatacctgacaatgtgaaatagttttattacaactggcctgaccttcaaaggccttcacagctcctgccttcatgttaccgtctactatgttcctcgtgcaccttccactcagcacaaacaggctgcactgcctccgaaacacatcactggaaccctgcctctgctcctttgtccatctgaatcaccctctccacatttctgaccctgtaatcctgatctcacttcatgaggcagttcgcttctcttttgcatttagctttccccggggtacactgtcaatagcctactgtctgatgtcatcagtcagcacttcatcagaggcaattatgtccacagagcttttggctaattactgtcactcctctttacatgtgtgcatatgcatatcatctttccctaatgagactggaaatcatgattcattccctggagcagtggtttccataagtgaccaacccacagaccagtgcaaactggctgcaaaagagcttcctctgaggaacttattagaatgcagattctttgactgcatgggagaggaggatctcataaatctgggtgtaataggcacagaacgttaggtgtaatatgggcgggactctggactcagcatatccaacaagctgctggctgattccgatgatgccgatgaattgccaggttgggaactgctgcccccagagaacctagcagagagctctgtacgtggtaggtgctcactcccctattgtttgggtgtatgcctcctgataatgaacttgatcgtaacattattgttgcattatgcctgtattgtttccttaggtgaaggaagaatgcttttgagtacctaataggtggcaagctctgtgcctacttacatacatgaactattccttttaataacctttggaaataaagtggcatttccattgggcattagaaatctgaagactttcgtttacagctgttgcaacagcagaactagaattcgacctccgacatttctgctcaccagagggcatgaactgctggtttgtacctggcttgcagataccttctttgggcagcacaatgttcaaaattaaaaaaactaccaacacttctaaactggatactttgtatcaatatctgggtttctggcttctcttcatgggaaacaaacaaacaaaaaaaaaggtttggtgaacaatggggcccacattcctgcagggcaacagtcacatggagactttagatgggcacgtgcccagaacacactagagtccccatcgctccccattctcttacattctgttcccaactaggttcttataggcctgggtttgtgcctgttgcacacttatctactctcttgcttcccactggtcaggaagtctggcaaacttaaaaggcctctttttgttgctctctcctgtatggatctctcatcatagaggtgtgtgcatttctgactttgtgatttcaatactaaggaagctgtcggcacattatcaaggaaaacggggatcgctgctccccaacgtacacattctggtgtgccccagtaaaattctatattcagcctccaaactagctgggaaaaatgtggcaaatcatctacttgctccaattcaatagtgtttagaagtaagaagtcactgtgagcaatgccaccaagtggtggagagactccatgcagaatcgccaccttcagccagagaggctgggaggccgaagacctctctcaatgcacagggccattcagaaactagaaacaaaatgcttgctcatctccctaggccactccttccgaggctttttgagacaaagtctcactgtcacccaggccggagtgcagtggcacaatcaaggctcactgcaacctcaaccttctgggttcaagcgatcctcccacttcagcctttcgagtagctgggatgactacaggcatgggccaccacacccagctgattttttttttttctttttagtagaaatgaggtctcgccatattgctcagactggtcttgaaccaacacatctttagctttttaaaagacagccttggccagccatggcagctcacacttgtaatcactgcactttgggaagctgaggtgggcagatagcttgagccgaggagttcaagaccagcctgggcaacatggtgaaaccccatctctacaaaaaatacaaaaattagctgagtgtgatggtgcacatctgtggtcccagctactggggaggctgaggtgggaggattgcttgagcctgggaggtcgaggctgcagtgagctgtgattacctcactgcattccggcctgggcaacagagaccctgtct

SEQ ID NO: 30506 - DNA, 3490 bp, Homo sapiens
aaaatccagagcggcgggcactgacgggcacttgcaccgtgtggacagactctccggttctggggaaatccagtccctgttactccattttggccagaaattcaagacatttcaggtggcagaataaattcaatccttgtttctccatcttatcgagtagtagaagttagttacattctctttgaactcatcatgaattccatgaagactgaagaaaacaagtcatttagcgctatggaagatgaccagaggactagacctgaagtttcaaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaagaaaaaagtccacaaaccaaagaaagatggagagaccaaagatgtagaacacagcagagagcaaattctcccacctcaggatctaagccattatattaaagataaaactcgccagacaattcccaggattagaaattattacttttgtagtttgccccgaaaatataggcaaataaactcacaagttagacggaggccgcatctgggtaggcggtatgctattaatctggatgtccaaaaggaggcaattaatctcttaaagaattatcaaacgttgaatgaagccataatgcatcagtatccgaattttaaagaggaggcacagtgggtaagaaaatattttcgggaagaacaaaagagaatgaatctttcaccagctaagcaattcaacatatataaaaaggacttcggaaaaatgactgcaaattctgtttcagttgcaacctgcgaacagcttacatattatagcaagtcagttgggttcatgcaatgggacaataatggaaacacaggtaatgctacttgctttgtcttcaatggtggttatattttcacctgtcgacatgttgtacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattggtcatcctgaaggccagatcaagaaaatagatggttgtactgtgattcctctaaacgaacgattgaaaaaatatccaaacgattgtcaagatgggttggtagatctctatgataccaccagtaatgtatactgtatgtttacccaaagaagtttcctatcagaggtttggaacacacacacgcttagttatgatacttgtttctctgatgggtcctcaggctccccagtgtttaatgcatctggcaaattggttgctttgcatacctttgggcttttttatcaacgaggatttaatgtgcatgcccttattgaatttggttattctatggattctattctttgtgatattaaaaagacaaatgagagcttgtataaatcattaaatgatgagaaacttgagacctacgatgaagagaaaggtaaacaagagtcatcacttcaagatcatcagattgaacccatggaatgttagaaaagagatgctgtcttcaagaaaatatgccaataattcctggcaaagatttcatgacaaagacacttaaagcaattgcaacaaaagtgaaaattggcaaatgagacctaattaaatcttctgcacagcaaaagaaactatcaacagggtaaacacacaacctacggaatgggagaaaatatttgcaaactatgcatacagcaaagatctaatattcagaatccattaggaacttaaacagattaacaagcaaaaaaaaacaagcaaccccattaaaaagtgggcaaaggacatgaacaaacacttttcaaaagaagatatacacatggccaacaaggatatgaaaaaatacctgatatcactaatcattagagaaatgcaaatcaaaaaaatgccatcacactaatcagaatggctgttattaaaatgccaaaaaattacagatgctggcgaggttgcagagaaaggggaatgcttatacactgctagtgggaaaataaattagttcagccattgtggaaagcagttgggtgatttctaaaagaacttaaaacagctaccattcaagccagcaatctcatgactgggtatatgtccaaaggaatataaattgttctaccataaagacatgcacatatatgttcactgcagcactattcacaatagcaaaacatgaaatcaacctaaatgcccatcaatggtagactggataaagaaaatgtgacacatatacaccatagcatactacacagccataaaaaagtacaagatcatgtgctttgcagcaacatggatggaactgaaggtcattatcctaagcgaactaatgcaggaacagaaagccaagtaccacatgttctctcataagtggaagctaaatattgagtacacatggacacaaagaagaaaacaacagatatggggcctacttgagggtggagggtgggaggagggtgaagactgaaaaactgcctatggggtactatgcttattacctgggtgatgaaataatctgaacacaaaaccctggtgacatgcagtttacctatataacaaaactgcacatggactcttaaacctaaataaaagttta

SEQ ID NO: 30507 - DNA, 4190 bp, Homo sapiens
caacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaaaaaaaaaaaaaaaaaa

SEQ ID NO: 30508 - DNA, 5956 bp, Homo sapiens
agtatccaccccgcccgctcccggtgacgtgccagccccaggcccacgccgctcccgccccgcgtgatgacgccaccgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtccagaggagaacgcttgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctc

SEQ ID NO: 30509 - DNA, 3667 bp, Homo sapiens
agaacagtgtggagtttggggaagagatgtggctaaagacagcgtaagcaattttttaaagttatgtctgaagcaagaagaaaagacaaggaataggttcagtttcatctctgatacactgtttcttgttaaaattgatgtttttttctgcaggcatttgcttcctgaatgatggtcccactcagccatccacctatactttctacaaagtcaatttatactgattcttcagatcagttaatcactggtacgtttcccctccccggtcaaggatcttttattatacgctatcatagaatcatattcctttccttagcgcacttctctcaactgataagtgccgccattaatgtacttacttgataaatatatgcctgcctttcctcttccagggccgaaactgtgcctggttttgctcatcattctacagtatatagcacgagttcaataaacagttgttaaagcaacatatttaacttacattttgttcccatctcttcactcagagacttttctttggattgggaagggtaaaatatccgaagatttgaactccaaaagaaacaaaatgattctatgcaaacgtttcctacttaaaactcattcattgggcaaatattcacttagtccctggcactatttggtaataggaatacaggagtgcatatggcagataaagttctgttgctgcccttaccaagtttcgtgggggtgagatgtggtgttagtaaatgcatactattttgtctgtatttaaatcgagtccaaatctctcgctctacagcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaactccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaaaggccgagggttaaggttactaaaatcagcgtttctgaatcctgtctcaagttgtctcaactgggcttccgtagaacggtttcttcgtaagagggccttcagcgacagccgagctcggaaaagaacgggaataagttgtctcttacatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacctatctagacaggcagctctcggccaccctccggggtcctgattttgaaaagaggagtggaccaatcagatgtggagcgctgtttggcgctgccatttgagcctgggctgaaactgcgggtgtgacccccccgtggtggctccgggtgtctgcagtggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttctcttcacatttcagagcgaaccagacggacagtaaggtttggaggaagggggatcgttggaagtagcaggaagtggagagaatctggcaataggcgagaaaccgaaagaatcagaaagaagtctatgtgagtagctgaaagcattgggtgaccagaaagaaggtcgctgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctcaacaagaaagaattgataatgaaacaaccaccatcggttaaatttgatccaaaaatattgcatctaccagcattttcagtggataagttataatttctgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctgttctaattgctaatccagtatttgcggatagctccaaactgggatatgaccaccattgtatatgcagaccattgactggaacatcatgatctatctgcacatgactgtaaataacaactattggatgtggcacagatggaagctacataaacactctatacaatatggccaattcaccgggctccctgttagtcttgtgagcaattttaaactcttccacgattctttctctgctttggagtgtttcaattaattctccattatattacaatttacatttttattaag

SEQ ID NO: 30510 - DNA, 1381 bp, Homo sapiens
aaactgcgggtgtgacccccccgtggtggctccgggtgtctgcagtggagctgggggcggaagcatgaggctaacggcttggcttcagtgaacgcaccgggatgtgcaggccgggagagcgaaccagacggacagtaaggtttggaggaagggggatcgttggaagtagcaggaagtggagagaatctggcaataggcgagaaaccgaaagaatcagaaagaagtctatgtgagtagctgaaagcattgggtgaccagaaagaaggtcgctgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaaggtacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaaga

SEQ ID NO: 30511 - DNA, 3112 bp, Homo sapiens
agaacagtgtggagtttggggaagagatgtggctaaagacagcgtaagcaattttttaaagttatgtctgaagcaagaagaaaagacaaggaataggttcagtttcatctctgatacactgtttcttgttaaaattgatgtttttttctgcaggcatttgcttcctgaatgatggtcccactcagccatccacctatactttctacaaagtcaatttatactgattcttcagatcagttaatcactggtacgtttcccctccccggtcaaggatcttttattatacgctatcatagaatcatattcctttccttagcgcacttctctcaactgataagtgccgccattaatgtacttacttgataaatatatgcctgcctttcctcttccagggccgaaactgtgcctggttttgctcatcattctacagtatatagcacgagttcaataaacagttgttaaagcaacatatttaacttacattttgttcccatctcttcactcagagacttttctttggattgggaagggtaaaatatccgaagatttgaactccaaaagaaacaaaatgattctatgcaaacgtttcctacttaaaactcattcattgggcaaatattcacttagtccctggcactatttggtaataggaatacaggagtgcatatggcagataaagttctgttgctgcccttaccaagtttcgtgggggtgagatgtggtgttagtaaatgcatactattttgtctgtatttaaatcgagtccaaatctctcgctctacagcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaactccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaaaggccgagggttaaggttactaaaatcagcgtttctgaatcctgtctcaagttgtctcaactgggcttccgtagaacggtttcttcgtaagagggccttcagcgacagccgagctcggaaaagaacgggaataagttgtctcttacatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacctatctagacaggcagctctcggccaccctccggggtcctgattttgaaaagaggagtggaccaatcagatgtggagcgctgtttggcgctgccatttgagcctgggctgaaactgcgggtgtgacccccccgtggtggctccgggtgtctgcagtggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttctcttcacatttcagagcgaaccagacggacagtaaggtttggaggaagggggatcgttggaagtagcaggaagtggagagaatctggcaataggcgagaaaccgaaagaatcagaaagaagtctatgtgagtagctgaaagcattgggtgaccagaaagaaggtcgctgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaaggtacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaaga

SEQ ID NO: 30512 - DNA, 2984 bp, Homo sapiens
agaacagtgtggagtttggggaagagatgtggctaaagacagcgtaagcaattttttaaagttatgtctgaagcaagaagaaaagacaaggaataggttcagtttcatctctgatacactgtttcttgttaaaattgatgtttttttctgcaggcatttgcttcctgaatgatggtcccactcagccatccacctatactttctacaaagtcaatttatactgattcttcagatcagttaatcactggtacgtttcccctccccggtcaaggatcttttattatacgctatcatagaatcatattcctttccttagcgcacttctctcaactgataagtgccgccattaatgtacttacttgataaatatatgcctgcctttcctcttccagggccgaaactgtgcctggttttgctcatcattctacagtatatagcacgagttcaataaacagttgttaaagcaacatatttaacttacattttgttcccatctcttcactcagagacttttctttggattgggaagggtaaaatatccgaagatttgaactccaaaagaaacaaaatgattctatgcaaacgtttcctacttaaaactcattcattgggcaaatattcacttagtccctggcactatttggtaataggaatacaggagtgcatatggcagataaagttctgttgctgcccttaccaagtttcgtgggggtgagatgtggtgttagtaaatgcatactattttgtctgtatttaaatcgagtccaaatctctcgctctacagcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaactccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaaaggccgagggttaaggttactaaaatcagcgtttctgaatcctgtctcaagttgtctcaactgggcttccgtagaacggtttcttcgtaagagggccttcagcgacagccgagctcggaaaagaacgggaataagttgtctcttacatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacctatctagacaggcagctctcggccaccctccggggtcctgattttgaaaagaggagtggaccaatcagatgtggagcgctgtttggcgctgccatttgagcctgggctgaaactgcgggtgtgacccccccgtggtggctccgggtgtctgcagtggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttctcttcacatttcagagcgaaccagacggacagtaaggtttggaggaagggggatcgttggaagtagcaggaagtggagagaatctggcaataggcgagaaaccgaaagaatcagaaagaagtctatgtgagtagctgaaagcattgggtgaccagaaagaaggtcgctgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaaggaactatgaaggcaactgttagaaagttggtatattactgacctcacccccaccctacagtaccggcccctcc

SEQ ID NO: 30513 - DNA, 3321 bp, Homo sapiens
agaacagtgtggagtttggggaagagatgtggctaaagacagcgtaagcaattttttaaagttatgtctgaagcaagaagaaaagacaaggaataggttcagtttcatctctgatacactgtttcttgttaaaattgatgtttttttctgcaggcatttgcttcctgaatgatggtcccactcagccatccacctatactttctacaaagtcaatttatactgattcttcagatcagttaatcactggtacgtttcccctccccggtcaaggatcttttattatacgctatcatagaatcatattcctttccttagcgcacttctctcaactgataagtgccgccattaatgtacttacttgataaatatatgcctgcctttcctcttccagggccgaaactgtgcctggttttgctcatcattctacagtatatagcacgagttcaataaacagttgttaaagcaacatatttaacttacattttgttcccatctcttcactcagagacttttctttggattgggaagggtaaaatatccgaagatttgaactccaaaagaaacaaaatgattctatgcaaacgtttcctacttaaaactcattcattgggcaaatattcacttagtccctggcactatttggtaataggaatacaggagtgcatatggcagataaagttctgttgctgcccttaccaagtttcgtgggggtgagatgtggtgttagtaaatgcatactattttgtctgtatttaaatcgagtccaaatctctcgctctacagcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaactccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaaaggccgagggttaaggttactaaaatcagcgtttctgaatcctgtctcaagttgtctcaactgggcttccgtagaacggtttcttcgtaagagggccttcagcgacagccgagctcggaaaagaacgggaataagttgtctcttacatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacctatctagacaggcagctctcggccaccctccggggtcctgattttgaaaagaggagtggaccaatcagatgtggagcgctgtttggcgctgccatttgagcctgggctgaaactgcgggtgtgacccccccgtggtggctccgggtgtctgcagtggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttctcttcacatttcagagcgaaccagacggacagtaaggtttggaggaagggggatcgttggaagtagcaggaagtggagagaatctggcaataggcgagaaaccgaaagaatcagaaagaagtctataatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctcaacaagaaagaattgataatgaaacaaccaccatcggttaaatttgatccaaaaatattgcatctaccagcattttcagtggataagttataatttctgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctgttctaattgctaatccagtatttgcggatagctccaaactgggatattgttctcaggcgctgtggtctcaccttccactggggcaacaatgggccatttccagcagggacggcgcagtgttggcctgcatgcctgactgccacacacctccagaatcaggtgtctgaaaagtggcagtgacgaaagaagagactctcccggccgaggccccagtgcatggagagaaggaagaaatcaatttcctaattggtaccatatacatcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgc

SEQ ID NO: 30514 - DNA, 3153 bp, Homo sapiens
agaacagtgtggagtttggggaagagatgtggctaaagacagcgtaagcaattttttaaagttatgtctgaagcaagaagaaaagacaaggaataggttcagtttcatctctgatacactgtttcttgttaaaattgatgtttttttctgcaggcatttgcttcctgaatgatggtcccactcagccatccacctatactttctacaaagtcaatttatactgattcttcagatcagttaatcactggtacgtttcccctccccggtcaaggatcttttattatacgctatcatagaatcatattcctttccttagcgcacttctctcaactgataagtgccgccattaatgtacttacttgataaatatatgcctgcctttcctcttccagggccgaaactgtgcctggttttgctcatcattctacagtatatagcacgagttcaataaacagttgttaaagcaacatatttaacttacattttgttcccatctcttcactcagagacttttctttggattgggaagggtaaaatatccgaagatttgaactccaaaagaaacaaaatgattctatgcaaacgtttcctacttaaaactcattcattgggcaaatattcacttagtccctggcactatttggtaataggaatacaggagtgcatatggcagataaagttctgttgctgcccttaccaagtttcgtgggggtgagatgtggtgttagtaaatgcatactattttgtctgtatttaaatcgagtccaaatctctcgctctacagcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaactccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaaaggccgagggttaaggttactaaaatcagcgtttctgaatcctgtctcaagttgtctcaactgggcttccgtagaacggtttcttcgtaagagggccttcagcgacagccgagctcggaaaagaacgggaataagttgtctcttacatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacctatctagacaggcagctctcggccaccctccggggtcctgattttgaaaagaggagtggaccaatcagatgtggagcgctgtttggcgctgccatttgagcctgggctgaaactgcgggtgtgacccccccgtggtggctccgggtgtctgcagtggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttctcttcacatttcagagcgaaccagacggacagtaaggtttggaggaagggggatcgttggaagtagcaggaagtggagagaatctggcaataggcgagaaaccgaaagaatcagaaagaagtctataatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctcaacaagaaagaattgataatgaaacaaccaccatcggttaaatttgatccaaaaatattgcatctaccagcattttcagtggataagttataatttctgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctgttctaattgctaatccagtatttgcggatagctccaaactgggatattgttctcaggcgctgtggtctcaccttccactggggcaacaatgggccatttccagcagggacggcgcagtgttggcctgcatgcctgactgccacacacctccagaatcaggtgtctgaaaagtaagtcctgtgttcgtggggccttaatggcaggccaaaggggcaagtgcagtcaccgcctctgacaatagagctg

SEQ ID NO: 30515 - DNA, 3269 bp, Homo sapiens
agaacagtgtggagtttggggaagagatgtggctaaagacagcgtaagcaattttttaaagttatgtctgaagcaagaagaaaagacaaggaataggttcagtttcatctctgatacactgtttcttgttaaaattgatgtttttttctgcaggcatttgcttcctgaatgatggtcccactcagccatccacctatactttctacaaagtcaatttatactgattcttcagatcagttaatcactggtacgtttcccctccccggtcaaggatcttttattatacgctatcatagaatcatattcctttccttagcgcacttctctcaactgataagtgccgccattaatgtacttacttgataaatatatgcctgcctttcctcttccagggccgaaactgtgcctggttttgctcatcattctacagtatatagcacgagttcaataaacagttgttaaagcaacatatttaacttacattttgttcccatctcttcactcagagacttttctttggattgggaagggtaaaatatccgaagatttgaactccaaaagaaacaaaatgattctatgcaaacgtttcctacttaaaactcattcattgggcaaatattcacttagtccctggcactatttggtaataggaatacaggagtgcatatggcagataaagttctgttgctgcccttaccaagtttcgtgggggtgagatgtggtgttagtaaatgcatactattttgtctgtatttaaatcgagtccaaatctctcgctctacagcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaactccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaaaggccgagggttaaggttactaaaatcagcgtttctgaatcctgtctcaagttgtctcaactgggcttccgtagaacggtttcttcgtaagagggccttcagcgacagccgagctcggaaaagaacgggaataagttgtctcttacatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacctatctagacaggcagctctcggccaccctccggggtcctgattttgaaaagaggagtggaccaatcagatgtggagcgctgtttggcgctgccatttgagcctgggctgaaactgcgggtgtgacccccccgtggtggctccgggtgtctgcagtggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttctcttcacatttcagagcgaaccagacggacagtaaggtttggaggaagggggatcgttggaagtagcaggaagtggagagaatctggcaataggcgagaaaccgaaagaatcagaaagaagtctataatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctcaacaagaaagaattgataatgaaacaaccaccatcggttaaatttgatccaaaaatattgcatctaccagcattttcagtggataagttataatttctgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctggtaggcctctgtgacatgacttatgcatttaaatgtatgtttttatagaggctcaaacaagtgctaaaatagcaatttgatttaactaccatgaaaaaactgatttatcatgattttaggtttatgcaaattatcgtctgcttaatccttaggtcttaaagtagatgagagtagatggtgattttgaactttctgttgttgttgtttgtaatacttagatttccattttatgttaacttgtaagattttaaaaaaatatataggctgaggcaggaaaatggcgtgaaccccaggggcgcggagcctgcagtgagctgagattgtgccactgcactccagcctgggcgacagcgagactccgt

SEQ ID NO: 30516 - DNA, 1515 bp, Homo sapiens
actagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgcttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgtt

SEQ ID NO: 30517 - DNA, 4342 bp, Homo sapiens
gcgaaattcaagctccaaactctaagctccaagctccaagctccaagctccaagctccaaactcccgccggggtaactggaacccaatccgagggtcatggaggcatcccgaaggtttccggaagccgaggccttgagcccagagcaggctgctcattacctaagggtcttgctgtgtcgcccagactggaattcagtggcctgatcatagttcactgcagcctcgaactcctgggctcaagcagtcctcctgccccagcctccctagtagctgggacttaagatatgtgaaagaggccaaagaagcaactaagaatggagacctggaagaagcatttaaacttttcaatttggcaaaggacatttttcccaatgaaaaagtgctgagcagaatccaaaaaatacaggaagccttggaggagttggcagaacagggagatgatgaatttacagatgtgtgcaactctggcttgctactttatcgagaactgcacaaccaactctttgagcaccagaaggaaggcatagctttcctctatagcctgtatagggatggaagaaaaggtggtatattggctgatgatatgggattagggaagactgttcaaatcattgctttcctttccggtatgtttgatgcatcacttgtgaatcatgtgctgctgatcatgccaaccaatcttattaacacatgggtaaaagaattcatcaagtggactccaggaatgagagtcaaaacctttcatggtcctagcaaggatgaacggaccagaaacctcaatcggattcagcaaaggaatggtgttattatcactacataccaaatgttaatcaataactggcagcaactttcaagctttaggggccaagagtttgtgtgggactatgtcatcctcgatgaagcacataaaataaaaacctcatctactaagtcagcaatatgtgctcgtgctattcctgcaagtaatcgcctcctcctcacaggaaccccaatccagaataatttacaagaactatggtccctatttgattttgcttgtcaagggtccctgctgggaacattaaaaacttttaagatggagtatgaaaatcctattactagagcaagagagaaggatgctaccccaggagaaaaagccttgggatttaaaatatctgaaaacttaatggcaatcataaaaccctattttctcaggaggactaaagaagacgtacagaagaaaaagtcaagcaacccagaggccagacttaatgaaaagaatccagatgttgatgccatttgtgaaatgccttccctttccaggaaaaatgatttaattatttggatacgacttgtgcctttacaagaagaaatatacaggaaatttgtgtctttagatcatatcaaggagttgctaatggagacgcgctcacctttggctgagctaggtgtcttaaagaagctgtgtgatcatcctaggctgctgtctgcacgggcttgttgtttgctaaatcttgggacattctctgctcaagatggaaatgagggggaagattccccagatgtggaccatattgatcaagtaactgatgacacattgatggaagaatctggaaaaatgatattcctaatggacctacttaagaggctgcgagatgagggacatcaaactctggtgttttctcaatcgaggcaaattctaaacatcattgaacgcctcttaaagaataggcactttaagacattgcgaatcgatgggacagttactcatcttttggaacgagaaaaaagaattaacttattccagcaaaataaagattactctgtttttctgcttaccactcaagtaggtggtgtcggtttaacattaactgcagcaactagagtggtcatttttgaccctagctggaatcctgcaactgatgctcaagctgtggatagagtttaccgaattggacaaaaagagaatgttgtggtttataggctaatcacttgtgggactgtagaggaaaaaatatacagaagacaggttttcaaggactcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaagtgttttcaaaaaaaaaaaaaaaaa

SEQ ID NO: 30518 - DNA, 4224 bp, Homo sapiens
gcgaaattcaagctccaaactctaagctccaagctccaagctccaagctccaagctccaaactcccgccggggtaactggaacccaatccgagggtcatggaggcatcccgaaggtttccggaagccgaggccttgagcccagagcaggctgctcattacctaagatatgtgaaagaggccaaagaagcaactaagaatggagacctggaagaagcatttaaacttttcaatttggcaaaggacatttttcccaatgaaaaagtgctgagcagaatccaaaaaatacaggaagccttggaggagttggcagaacagggagatgatgaatttacagatgtgtgcaactctggcttgctactttatcgagaactgcacaaccaactctttgagcaccagaaggaaggcatagctttcctctatagcctgtatagggatggaagaaaaggtggtatattggctgatgatatgggattagggaagactgttcaaatcattgctttcctttccggtatgtttgatgcatcacttgtgaatcatgtgctgctgatcatgccaaccaatcttattaacacatgggtaaaagaattcatcaagtggactccaggaatgagagtcaaaacctttcatggtcctagcaaggatgaacggaccagaaacctcaatcggattcagcaaaggaatggtgttattatcactacataccaaatgttaatcaataactggcagcaactttcaagctttaggggccaagagtttgtgtgggactatgtcatcctcgatgaagcacataaaataaaaacctcatctactaagtcagcaatatgtgctcgtgctattcctgcaagtaatcgcctcctcctcacaggaaccccaatccagaataatttacaagaactatggtccctatttgattttgcttgtcaagggtccctgctgggaacattaaaaacttttaagatggagtatgaaaatcctattactagagcaagagagaaggatgctaccccaggagaaaaagccttgggatttaaaatatctgaaaacttaatggcaatcataaaaccctattttctcaggaggactaaagaagacgtacagaagaaaaagtcaagcaacccagaggccagacttaatgaaaagaatccagatgttgatgccatttgtgaaatgccttccctttccaggaaaaatgatttaattatttggatacgacttgtgcctttacaagaagaaatatacaggaaatttgtgtctttagatcatatcaaggagttgctaatggagacgcgctcacctttggctgagctaggtgtcttaaagaagctgtgtgatcatcctaggctgctgtctgcacgggcttgttgtttgctaaatcttgggacattctctgctcaagatggaaatgagggggaagattccccagatgtggaccatattgatcaagtaactgatgacacattgatggaagaatctggaaaaatgatattcctaatggacctacttaagaggctgcgagatgagggacatcaaactctggtgttttctcaatcgaggcaaattctaaacatcattgaacgcctcttaaagaataggcactttaagacattgcgaatcgatgggacagttactcatcttttggaacgagaaaaaagaattaacttattccagcaaaataaagattactctgtttttctgcttaccactcaagtaggtggtgtcggtttaacattaactgcagcaactagagtggtcatttttgaccctagctggaatcctgcaactgatgctcaagctgtggatagagtttaccgaattggacaaaaagagaatgttgtggtttataggctaatcacttgtgggactgtagaggaaaaaatatacagaagacaggttttcaaggactcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaagtgttttcaaaaaaaaaaaaaaaaa

SEQ ID NO: 30519 - DNA, 1236 bp, Homo sapiens
caggcgctgacgaggagcccggctgagggaggatgcgccgctgacgcctgcgggagccgcgcgcctggggcgggaggatgctccagaggggcctctggccgtggcgcacgcggctgctgccgacccctggcacctggcgcccagcgcgcccgtggccgctgccgcctccgccccaggttttgcgtgtgaagctgtgtggaaatgtgaaatactaccagtcacaccattatagtaccgtggtgccacctgatgaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaaaaaaaaaaaaaaaaaaaaaaaaaa

SEQ ID NO: 30520 - DNA, 2726 bp, Homo sapiens
cggcacgaggctggttgccggggcaggggcggaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctggccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagaggaaaaaaaaagaaaaaaaaa

SEQ ID NO: 30521 - DNA, 5410 bp, Homo sapiens
gcggcggcggcggcggcggcggcggcggcggccggggcgggagcggggcgcgctctggagacgagtcagcggcgccccgggtgggggaggcgggcgggcagctagagatcacctcagcagcccccaccacggccggaccgaaggtgcggcggcggaggggagccagggcgccccagcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggagtgcatcagagaatttagatgagctgtcttcctccagtagctggttacttaaccagaagcacagtaagaaaaagagaaaagacaggacaagactgaaatcttcatccttgactttcatgagtacatcagcccgaacaaggccacttcagagtttccacaaacgaaaactgtacagattgagccctactttttattggactccacagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctgtacatagtactctgaatcaatggagaaatggatattcacctatatgtaagcctcaaataaggtcagaatcttctgcacaactgttacagggaagaaagaaaagacatttgagtgaaacagcattaggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtgacagggaacaggttaagaaaactatgtaaatgtaggaaagatgggaggaaataaagccctgttctggatcccccatcccctccagaataagagcatgttctgcatgtattaatcttttatgctgtttatgaaacaggcaagataagtctgtttttccttctggaaccataagggtaaccagattttcatctacagacaagtggtagtcatttgtgtttatcatgcaacttacttacaaacaccaagatattaattgctgcaacttgatgtcaaatcacattactgggtaatttttaagactatgtacccacaccatacatacatacatatatatatacacatacatacaaacctgtgtgccaagtgacagctatttttttatatacatggtaattcattaaaattgccttagtaatatattagaatatacaaatatgtgtgtataaaataaacatacacacacacacacacccctatgtagtttttaaaacactggcaatgacccactccccttggaaatgcatgtatgaactaccctatgaaatgtaagctgcagaatagataaaacacaggtttccactaataaaagacatctgaacgtcctgaatatagagacagaagttttttgttgttgttgttgttgttttaacatgtttaaccaacagaagttatttacagaaattcatatatccaggcaacacaaaactcctttattcaaaatcactgctatctttgggactaaacacaggctactttctgtttactcctaacaaaataaagcaagcaaatttgagtcaaatattggtgcactttaatactatcacatctttgaaaactcaatttgagttttaccaattaatgtgtctcatgaagagaagacaccagttttaaaatgagccacaaacagtaaagccctatcagtataaaatttgaaaaaaaaaaaaaagatgattgtatttctagattagcaagaaattagttaattctggctgatttctatttctagctaatttggtcattctttgccatagcttactctattcaaataaacatatattcttgcttgcatcctagattggaaattaaaatttttcaaagaacaaagcttcaatattggatactgaagagtatacatgaaagaaaattccttttgaagctattaaaccatttttttcctatgtgaaagttgaggacaatttatataactcactttttgtcatgtaaaaaaggttactcaagttgtactacccacataactgaaaatattggccatttggccttatctgtgagatttgacactaagtttttgttagagattggaaattatactagtccttttaaggggtaaaaaattcaattcaatactgacaaacttttgcttgtagttttactgtacatttatttttaaagaaaaagaaaacaaaagccagacaaacccaagttgtccaggcaaataaactcaaatctttgtcacgtctgatattataatcttctatgtaagttttttaattaaagttatttctatatgccgtgtgttgcttgttattaaatgcgacgtattcatggcacaaagctttcccaagctgaataaaaacaaacattaacaaatttttaccttgtaatgcaggaagaaacccaagcaagctctagtctgtgcttaagtgttagcattcttattttttgaaccttatttctcaaaacttatagtagcctcaagaagtctattgatattggtcatgtttatttcttgccatatttataacacagcaagagtatttacaggaatgaagtagctgacacatatttttagactctgtataattcagaacagttataaatatttagtttatggattgactctgtatcctgtcatcttttcgcctacctgatctttcttggaataaaataatatatccttggggtcaagatccatagttccagaattttctcagccatctggttctgctacagcgtaaaattagactggaaataagacaacgttaagtaaaaagcttcttttacctaacccacctcccaagggctccatttgtaaaagtacagaccagaaattctaccacttcccagatcctttccagggtaccaccctattaagcattaatttcttcattttttaaatggggacaaaaatatctgctttattattaccacttacttatagaggtgatttacagatttaatgagaatatatcaaagtactttataactcacaaaaatataa

SEQ ID NO: 30522 - DNA, 2212 bp, Homo sapiens
agttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggctcttcaaaggcctaaaagctaaaggcgaggatggattaattcaacaagtcctagtcgtgcgccctggtgagtgccagaccctgctccccgcgaggggacccatgagccaccctcaccacgatccctgccctggtggagcccccgtgcgggacacaggatccgaagatggcagcggaagttcctcagcggcctcaaaagtgactgggcagagtgggcacaggctccctcactgggtgaaggaggcgcaaagaacgggaagagccatcccgggagcccaccggcctttcagtttcccttgggcccccaggcggttcaggtatgtgtcggggccggggcgtttccggcagcttttgatgaaggcgaggggcaaggtcgtcctggttccagaatctcccaacctgcggatctccaatgagactaacacgattcaccactctaatctcttcagttttccaaagccttgcacagttgtactgtctggtgggctctgaggttgggacggttgggggagtgtttggtgagtgcacccttcctatagtgcccagaagaaggtacaatacctgtctctgtggcacaatcggttagcgcgttcggctgttaatctagaggttggtggttagagcccactgagggatgcctcctccagatttttttttttttttttctgagacagagtcttgctctgtcgccaggctggagtgcagtggcgcgatctcggctcactgcaacatccgcctccctggttcaagcgattcccctgcctcagtctcccgagtagctgagaatacaggcgagcgccaccccgcccggctaatgttttgtattttagtagagacagaggtttcaccttattggccaggatggtctcgatcagctgacctcgtgatccacccgccttggcctcccaaagtgctgggattacaggtgtaagcaaccgcgccctgcccggctgcctgcttcagcttttaaagcgttcatgcattatcaatcactagataaacggcggagattatatcttcccagagtcctaagccactagggttgtgtctctgtggcacaatcagttgtcgcatccaaaaggcctagctaacttttgtattttttgtagagaaagggtttcattatgttgcccatgctggtccccaaactcctgggctcgggcacctccgaggtctcccaaagtgctaggattacaggcatgagccactgcacagggccttatacaatgcttctaatttcagcacatttagcaaacttatcttctgcgggagaggtaccaaatcacattccagtttatttctcaactctaataatgtccctttcttcatttacttgctgacacaacaaattttctcccctcccgtactttttgttttgagactaggtgtcactctatcacccaagatggagtgcagtggcatgatctcatgtcactgcaaactcaccgcccctgcaaccatggcactagtgatcctccagaagagctggaactacagagaggacatcttgctgtgttttccaggctggacctgaatgaactcctgggctcaatcaatccttccacctcagcctaacatttacactgggagcagagatgcatttggacatataaactgttaacatgaggtaagcgccaaggtctagagaaggcagtggaagagatggcaaactccggcaccatgtctgcgtgtccagtgtgctctgctggagcagcacatttttgtacattgctgtatttgaaaaaaccctgcaagaatcatgaaactggacgaccatctttataacactcccagtgataaaacaagtaagaatggctggtttgtagtcatctgagcagcctctctagtttcgtagatatggtttctctctgatatcgaacgacttccaatgtcaagcggaatgctacatcacaaggataaccgtatgtgaaaagaaccagttttctttgtaatcctgaactttctagtttgcgcattaaaagacattatttgaagaag

SEQ ID NO: 30523 - DNA, 3088 bp, Homo sapiens
gctggaagggtttctttggccctgagtgaagagagacccagagggaacactgaggtgcctgcccaaccactctgtcccggtttccttcagcaggaccaggtgagagaagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacttcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgggaggccagggtgggtggatcacttgaggtcaggagttcaagactagcctggccaacatggtgaaaccccatctcgactaaaaatacaaaaattagccaggcgtggtggtgcacacttgtaatcccagctactcgggaggctgaggcaagagaatcacttgaacccaggaggcggaggttgcagtgagccaagatggtgccgctgcactccagcctgggtgacacagcaagactccatctcaaaaaaaaaaaaagaaaaagaaatgaacgggttcaaagaccataatcatgcatatcacataagaccagaagtggcccaggtccagggtcagttaatttagcagctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagctcactgttttcttttctttttcttttctttttttttttttgagatggagtcttgctgcatcccccaggctggagtgcagtggcatgatcttggctcactgcagcctccgcctcccaggttcaggcgattctcctgcctcagcctcccgagtggctgggattgcaggtgcgtgccaccacgcccagctaattttgtacgtttagtggaaatggagtttcaccatgttggtcaggctggtctcaaactcctgacctcatgatccgccttcctcggcctcccaaggtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctgagtgaacttcagggcgttccgttcattctttcagtaaatggttgcagcacatgttttacatgtcaggcagtgaaaccccccacagcagccttccctctcagaggatacatttgtaaccattacacagtcatcaaaggaataattttttttaatcaccagtgtgcatacagtcatggagctgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaattatgactttgcggatggg

SEQ ID NO: 30524 - DNA, 1833 bp, Homo sapiens
agaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtac

SEQ ID NO: 30525 - DNA, 1918 bp, Homo sapiens
agaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtac

SEQ ID NO: 30526 - DNA, 1182 bp, Homo sapiens
aatgagggcctccagggggcgggtcggactgccgcgggccggggagcgctctgggtggccagctgtgggcccgggccgtcgtgggctccggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcgtgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtgaacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaattgcaaaaaaaaaaa

SEQ ID NO: 30527 - DNA, 3143 bp, Homo sapiens
tgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatcgagatgctaaagtcagacattggaattggaagaactactaaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcacctagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaaacttgatctgaaagaaaattatcagcttcaattggcgattgattcagtgcccacaatgtaaacagggttggtagttgttactcattttgaatataccttttccttattgtattctgtaatataggatcctggaaatgagacctggtggaatattattttcaactgtagtctttctatactgtggactaatgaaatggtgttgttgataaatctaaaataaccaataatccaaaaaagttcatttt

SEQ ID NO: 30528 - DNA, 2331 bp, Homo sapiens
cttcgcggcttggtaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggcaaaaaaaaaaaaaaaaaa

SEQ ID NO: 30529 - DNA, 2279 bp, Homo sapiens
gcattctagtgcgaccttgtttacacctcccctggctcagtcacacagctgtgtggtaggctactagaagtgtttagtagttgtcactgggatcatgctgatgtggccccatccccgcctctccctgccctgtgatatcggaggaaacctgacagagcaaattggccatggccaagaaaaaggaaaagaaagagtgccaccaaaagcagggagccctaagggagcagttacaggtcctctttggattccagcacgacgcatcaaaccataccatgacgtgactaggacccaacctagaaatgaaggaactgaccctacaggactcacaaccctggataatgcagtgtcctcggacggcaacaagctctggacattacctgggggatgctgaaggcggcaactgaggaggctgaatgaatcctgctccagacacagacaccattcactccagataatttgttgcttgctatgctctctgttgtacattgcaactcgcatagggatgcaaagccggaataagagcaatgaccaccatgcctgacagacctgttgctgcgcacacctgtactctccaatgaacaagactgaatgcaaaaaaaacagaaaatggggagatttaggggatcagtcagtgtggttggaaaattgtaagatgaagttacaggatatagacacaaaccttcttggaaggccagaaggtttgcatagcttcagtaaaggatttggctgaaatcctttttacctctaatcccctttaccttgagttgatagcaatagagcaaataacatgggaatgtgggggagtttatctgaatagcttgtttactcatgtggtcctaagaccaacctttgattatccgcaggtgcatgattgctctctacctgggggcagggggagttaattacccacaggtggagctgaagagccaggaggctcagagtctgcagcagcagcaggaccagtacctgggtcatctgcagcagtatgtggccacctatcagcagcaggtggtcacctatcagcagctgacctctgaggaggaggagctgcacaaccagttactgctgcagacccagctcgtggaccggctgcagcagcagaaagctcaaagcaaagctgtggccaagatgggctgccaagagttgcgggagacccaggagcacctggaagctatcagccagcagaaccagcagcctcaggcccagttgagcctcatggctctccctggggaaggagatggacagtgaggaggaggaggaggtgcctcagcccatgccaagcatcccggaggatctagagagccagaaggccatggtggcatttttcaactcagctgtagctagtgccgaggaggagcaggcacggctatgtgggcagctgaaggagtgcactgccagcgcctggctcatctgttggcctcggcccagaaggaacctgaggcagcagccccagccccaagaactgggggtgatcccatgtgtggggagacccaccaggccctgcagggggccatggagaagctgtgggagagtacatcgcactgtaccagagccagagggcagtgcggaaggaggaggagtgcatcagcaggctggcccaggacaagggagaggtgaaggtgaagctgctggagctggcgtggcttgtggacgactgcaacaagtggcatagcagattcctggcagctgcccagaaccctgctgatgagcccactccaggggcccccgccccccagtagcttggggctactgacaagccagggtagtgagtagagtcctcaggcacagtgggcacgcaggagcaggggagggctcccacagcaccctgcctccctctctccaaagatctttgtgaggtgagccttgccagcagtggggagtctgcacaaggagaggcggggaagcattctccctgtgacaaccccactgagcagcagatcatgcaactgcttcatgagatgcagaacctccaggagcacccaggcttgggcagcagcccttgcattccttttttgtaccagactgatgagaacaatgaggtgaagatcaccatcatctaaaagccggccactgtcagcaaaacctggggaagtggggctggaggctctgcccctaccatgtccctaccaccccttcccagtcaaccctttaccctcacagtagcaagcataagacccctgtctaatgtggggagacaggtggagatgaggtgaagatcaccataatctaaaaggccactaaataaaaaaataaaaaattttaaaaaaaaaaaaaaaaaa

SEQ ID NO: 30530 - DNA, 3714 bp, Homo sapiens
gcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattc

SEQ ID NO: 30531 - DNA, 2977 bp, Homo sapiens
agaggcaggcggcttgtgagacgggctccagagaaaggacctccctgggtctctcatttcctggctgaagtttctcttctcgctgctgtggcagcatccaacccacacacacaggacccgcatcctgggtgatgaagtcagacacgcagcagctgggtgagtgctaacgctcagataagcatctgtgccattgtggggactccctgggctgctctgcacccggacacttgctctgtccccgccatgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactgaacaagcagaccaacaacactgaggaagatagagtggtgacttagaattaactcgtgctaaggggtcgggggctttgaaaatgccacccccctttcttattgcaagacggcttctcgcacatgaactgcatccttctcattctgtcggaaatgaaattcacacaactataccttttggggaggttccagttgattgaagtgagttggctgcattttcttatctgatcacaatggcaggggacagaatgtgcatggagtggagcatgtgtgtgttgggaggggggctaggaactgcacagcccttgtgtaattttcgttgtttgtttttgttttgagacagagtctcactctgtgtcccaggctggagtgcagtggcacagtctcggctcactgcaacctctgcctcccgggttcaagcaattctcctgcctcagcctcccgagtagctgggattagaggcgccagccaacacacccggctaatttttgtatttttagtagagacagggttttgccatgttggccaggctggtctcgagctcctgacctcaggtgatccgcctgccttggcctcccaaagtggtgggatcacaggcgtgagccaccgtgcctggcctcccctgtgtcattttaaatggctaagtaaatgggtatatgtgtttgaatggggcatgttcactctcttaggggctatggggcagttagcagcatttcctatcctctgaccttaaatcattccttatctcagaaaacagaaaccgggctcagtcaatcaatgctttatttcaggccgaatgaggctctttagattgggatctattgatctatcaattttcatctttacatttctttgtacatctgtacattttgtccaaatgtacatctgtacgtctgtcatcattgtgacttcctggtagcccaagaagaacaacaacaaaacaatctgctctgaccttcttcaaatctttgtatttcaaagaaggtgctgagggatctgtttccttgccctggcttctccagtgggatgtgctgagtccaatacaattgcttttataattgcttttgacaacttgtcatgtgactgtgaattgaaattattcacttattttccaagtatttactgaattcgtatttggtggcaggcagtatactgtgtaatttttagtggagggtcattagtcaactcttatgtgacagtaaagttttttgggggggtggggacagagaagttaagagctttcatcctttcacggaatacagtttctagaccgattctgtgtgaacatcagttttgtcctcttattgcaagactccctcatacacatgagtttcccaaatgtgtacctggacccctcgaaacagaggactctacgaaatgacaagctgcccctgccctgaattagggggaaacattccaggccaactctagctcctttctcaagctacaaagtggtgaacatggttctcaactccttaatttatactctctcaaatgcccaggatactctacccacttaagaaccttgccaacttctgggggttgggcatggtggctcacgcttgtgatcccagcactttgggagactgaggcggatcacctgaggtcaggagttctagaccagcctgaccaacatggagaaacctcgtctctactaaaaattcaaaattagcctggtgtggtggcgcatgcctata

SEQ ID NO: 30532 - DNA, 1344 bp, Homo sapiens
gggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaaccactttattatcaaa

SEQ ID NO: 30533 - DNA, 1744 bp, Homo sapiens
cggcggtgggcggggctcacgcgaggcgctggaacggtccgggagattctcgctctgctgctttagcttcggagtgtttggcgatggggcagcgcgagatgtggaggctcatgtcgaggtttaatgcattcaaaaggactaataccatactgcaccatttgagaatgtccaagcacacagatgcagcagaagaggtgctattggaaaaaaaaggttgcacgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaattgttttggaaaaaaaaaaaaaaaaaa

SEQ ID NO: 30534 - DNA, 1710 bp, Homo sapiens
cggcggtgggcggggctcacgcgaggcgctggaacggtccgggagattctcgctctgctgctttagcttcggagtgtttggcgatggggcagcgcgagatgtggaggctcatgtcgaggtttaatgcattcaaaaggactaataccatactgcaccatttgagaatgtccaagcacacagatgcagcagaagaggtgctattggaaaaaaaaggttgcacgggagtcataacactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatatcagagtgatctcggaagctgaaaaggcaaaacagaagatagctccagttttcttcagagaagaatatatgctgaataatgctgttggttcttgccagaaaccttatgttgcacttattcatggaattacaatgggtgggggagttggtctctcagtccatgggcaatttcgagtggctacagaaaagtgtctttttgctatgccagaaactgcaataggactgttccctgatgtgggtggaggttatttcttgccacgactccaaggaaaacttggttacttccttgcattaacaggattcagactaaaaggaagagatgtgtacagagcaggaattgctacacactttgtagattctgaaaagttggccatgttagaggaagatttgttagccttgaaatctccttcaaaagaaaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaattgttttggaaaaaaaaaaaaaaaaaa

SEQ ID NO: 30535 - DNA, 8546 bp, Homo sapiens
acacctgcgcgccggaataattcatgaagaaggggctggatccgtgggtcagagaacacaggaccagtttgccatcccaaggccgaaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaataatacaatggcaatactgacatccttcatgacgttttcccgacagacattcaggcagaaagtgctggtgcgttttctgtctgcaaagtagagggccatcgctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctccgacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacacgttccgcagcaccctctgacaccagcattcatgtcgcctggcaaacctgagcatctcctggaggggtccacatggcaactggttagccccatgagactcggaccctctggctccttgctggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctctccaccgaagacaagcccagcctggtgcctttgtctgtaccccggacgcaggtgatcgagcacatcacgaagctcatcaccatcaacgaggccgtggtggacaccagtgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccgcagcagtcacgtgtttacctcccacccccggatgctgaagccgcagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaaggctccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccgatccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagccggggaggccccgccagagagaagaaaatgcttcttggtgagaagcccctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccgcattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcaacccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagccaagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggcaagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggccacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggccctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggccccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcagggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccggccaaccccgagccttctgccaccccgccgctggaccgcagcagctctgtgggctgcctggcagaggcctctgcccgcttcccagcccggacgaggaacctctccggggaatccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccatccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggcagcactcctgtgtacag

SEQ ID NO: 30536 - DNA, 3434 bp, Homo sapiens
gccccgctgcccacctgcccgcctgcccacctgcccaggtgcgagtgcagccccgcgcgccggcctgagagccctgtggacaacctcgtcattgtcaggcacagagcggtagaccctgcttctctaagtgggcagcggacagcggcacgcacatttcacctgtcccgcagacaacagcaccatctgcttgggagaaccctctcccttctctgagaaagaaagatgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgattaatgtattcattatgctacagaactgacataagaatcaataaaatgattgttttactctgcaaaaaaaaaaaaaa

SEQ ID NO: 30537 - DNA, 1610 bp, Homo sapiens
cccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 30538 - DNA, 1843 bp, Homo sapiens
caggaattcggcgaagtggcggagctggggccccagcgggcgccgggggccgcgggagccagcaggtggcgggggctgcgctccgcccgggccagagcgcaccaggcaggtgcccgcgcctccgcaccgcggcgacacctccgcgggcactcacccaggccggccgctcacaaccgagcgcagggccgcggagggagaccaggaaagccgaaggcggagcagctggaggcgaccagcgccgggcgaggtcaagtggatccgagccgcagagagggctggagagagtctgctctccgatgactttgcccactctcttcgcagtggggacaccggaccgagtgcacactggaggtcccagagcacgacgagcgcggaggaccgggaggctcccgggcttgcgtgggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 30539 - DNA, 892 bp, Homo sapiens
cagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaatggccttcgtggcc

SEQ ID NO: 30540 - DNA, 3392 bp, Homo sapiens
gcggagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcggcccccggccctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagtgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagttcggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcactctcagctttccctgccacatccagcttgttgtcccaatgaaatactgagatgctgggctgtctctcccttccaggaatgctgggcccccagcctggccagacaagacgactgtcaggaagggtcggagtctgtaaaaccagcatacagtttggcttttttcacattgatcatttttatatgaaataaaaagatcctgcatttatggtgtagttctgagtcctgagacttttccgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgataaaaaaaaaaaaaaaaaaaaa

SEQ ID NO: 30541 - DNA, 4366 bp, Homo sapiens
tgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaat

SEQ ID NO: 30542 - DNA, 1449 bp, Homo sapiens
atgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcggcgctcgagagccccggcgaggcggaggcgcgggcgcgctggggcgccacgctgcgcaacttcagcgctgcgcacggcgtggccgagccagagctgcgcgccttcctccggcactacgaggccgcgctggccgccggcgtccgcgccgacgcgctgcgcccgcgctgggacttccccggcgccttctacttcgtgggcaccgtggtgtcaaccataggtttcggcatgaccacccccgcgacggtgggcgggaaggccttcctcatcgcctacgggctgttcggctgcgctgggaccatcctgttcttcaacctcttcctggagcgcatcatctcgctgctggccttcatcatgcgcgcctgccgggagcgccagctgcgccgcagcggcctgctgcccgccaccttccgccgcggctccgcgctctcggaggccgacagcctggcgggctggaagccctcggtgtaccacgtgctgctcatcctgggcctgttcgccgtgctgctgtcctgctgcgcctcggccatgtacaccagcgtggagggctgggactacgtggactcgctctacttctgcttcgtcaccttcagcaccatcggcttcggggacctggtgagcagccagcacgccgcctaccggaaccaggggctctaccgcctgggcaacttcctcttcatcctgctcggcgtgtgctgcatttactcgctcttcaacgtcatctccatcctcatcaagcaggtgctcaactggatgctgcgcaagctgagctgccgctgctgcgcgcgctgctgcccggctcctggcgcgcccctggcccggcgcaatgccatcaccccaggctcccggctgcgccgccgcctggccgcgctcggtgccgaccccgcggcccgcgacagcgacgccgagggccgccgcctctcgggcgagctcatctccatgcgcgacctcacggcctccaacaaggtgtcgctggcgctgctgcagaagcagctgtcggagacggccaacggctacccgcgcagcgtgtgcgtcaacacgcgccagaacggcttctcgggcggcgtgggcgcgctgggcatcatgaacaaccggctggccgagaccagcgcctccaggtagaccgcccgtccgcccgcgccggggaccctctccaggccgcggggccgccgggcgtggtttgcttctctcagtcactgctggcgctttcttaatctttatccaataaaatgaaacaaaaaaaatttttttaaaaaaaaaaaaaaaaaaaaaaaaaaa

SEQ ID NO: 30543 - DNA, 3340 bp, Homo sapiens
agtatgggacgatggcttgttagtacaagtgactctgttttggaaattacggacaagaaaccttggaggaagaacggcattaaagatcaaaagcatgatgactcctgatgaaaacatcaccaaatgatgaacccacgagcaaaaagggatttctacttggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctctttccctaatgtgccataaggcctcagaatgaatgagaattgtttctggtaacaatgtagctttgagggatcagttcttaacttttcagggtctacctaactgagcctagatatggaccatttatggatgacaacaattttttttttgtaaatgacaagaaattcttatgcagccttttacctaagaaattttctgtcagtgccttatcttatgaagaaacagaacctctctagctaatgtgtggtttctccttccctgcccccacccctaggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaaaatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagcttctaattgctttttgatgtatgaaaggcttatataattttcttttcgttgggtgacttttgccagatgagaggaggtggcacagtggtgagtgcagggcacagtcctagccttctgtgggtatacttttggagttgtgacttggctgtgagggcagaagttgaagttgggatcactgtgactttgcacatggaaaaatgcagattgcaggcataattcatctctgacattagagaaaaagctgttatagcacaatttaaattttgagagtttgctgtgtttttttttcacataaaagaggctgattattctttttagtttaattttatatcctgtaattctttggatggttccaagattcagaaaaaattcagtaaatgcaccccgtaaattgctaccctttcctttattttcatacttagatctgctgtacattgtatatatatataatttttaaaatgcagaaagaaaataatttccctaaatataattgcaaactgatttcttttacttttttgtgtgtgggggtgggagctgtatctgaataagtggcattcagattagggtcttgaaaaataaacccagaatctttaaaagaagcaaataaactaatagacgcttattttccaaaatttaaatttaagctagaaatgtaaatattcaattaatttgttaaaagtacttttataaagttaaaaaaaatccaaccaaaattttagaaagtcaggctcttttagaaagaaagctacacccatttcctcaaataactgttccgaaaatttatatggtggaatgcgccatgtataaactgtgaattgtattgacaaataaagtttgtaattaaagtcagca

SEQ ID NO: 30544 - DNA, 3212 bp, Homo sapiens
gcgggagagacccggctatagagcaggagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctctttccctaatgtgccataaggcctcagaatgaatgagaattgtttctggtaacaatgtagctttgagggatcagttcttaacttttcagggtctacctaactgagcctagatatggaccatttatggatgacaacaattttttttttgtaaatgacaagaaattcttatgcagccttttacctaagaaattttctgtcagtgccttatcttatgaagaaacagaacctctctagctaatgtgtggtttctccttccctgcccccacccctaggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaaaatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagcttctaattgctttttgatgtatgaaaggcttatataattttcttttcgttgggtgacttttgccagatgagaggaggtggcacagtggtgagtgcagggcacagtcctagccttctgtgggtatacttttggagttgtgacttggctgtgagggcagaagttgaagttgggatcactgtgactttgcacatggaaaaatgcagattgcaggcataattcatctctgacattagagaaaaagctgttatagcacaatttaaattttgagagtttgctgtgtttttttttcacataaaagaggctgattattctttttagtttaattttatatcctgtaattctttggatggttccaagattcagaaaaaattcagtaaatgcaccccgtaaattgctaccctttcctttattttcatacttagatctgctgtacattgtatatatatataatttttaaaatgcagaaagaaaataatttccctaaatataattgcaaactgatttcttttacttttttgtgtgtgggggtgggagctgtatctgaataagtggcattcagattagggtcttgaaaaataaacccagaatctttaaaagaagcaaataaactaatagacgcttattttccaaaatttaaatttaagctagaaatgtaaatattcaattaatttgttaaaagtacttttataaagttaaaaaaaatccaaccaaaattttagaaagtcaggctcttttagaaagaaagctacacccatttcctcaaataactgttccgaaaatttatatggtggaatgcgccatgtataaactgtgaattgtattgacaaataaagtttgtaattaaagtcagca

SEQ ID NO: 30545 - DNA, 3198 bp, Homo sapiens
gtctctgaataagaatggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctctttccctaatgtgccataaggcctcagaatgaatgagaattgtttctggtaacaatgtagctttgagggatcagttcttaacttttcagggtctacctaactgagcctagatatggaccatttatggatgacaacaattttttttttgtaaatgacaagaaattcttatgcagccttttacctaagaaattttctgtcagtgccttatcttatgaagaaacagaacctctctagctaatgtgtggtttctccttccctgcccccacccctaggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaaaatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagcttctaattgctttttgatgtatgaaaggcttatataattttcttttcgttgggtgacttttgccagatgagaggaggtggcacagtggtgagtgcagggcacagtcctagccttctgtgggtatacttttggagttgtgacttggctgtgagggcagaagttgaagttgggatcactgtgactttgcacatggaaaaatgcagattgcaggcataattcatctctgacattagagaaaaagctgttatagcacaatttaaattttgagagtttgctgtgtttttttttcacataaaagaggctgattattctttttagtttaattttatatcctgtaattctttggatggttccaagattcagaaaaaattcagtaaatgcaccccgtaaattgctaccctttcctttattttcatacttagatctgctgtacattgtatatatatataatttttaaaatgcagaaagaaaataatttccctaaatataattgcaaactgatttcttttacttttttgtgtgtgggggtgggagctgtatctgaataagtggcattcagattagggtcttgaaaaataaacccagaatctttaaaagaagcaaataaactaatagacgcttattttccaaaatttaaatttaagctagaaatgtaaatattcaattaatttgttaaaagtacttttataaagttaaaaaaaatccaaccaaaattttagaaagtcaggctcttttagaaagaaagctacacccatttcctcaaataactgttccgaaaatttatatggtggaatgcgccatgtataaactgtgaattgtattgacaaataaagtttgtaattaaagtcagca

SEQ ID NO: 30546 - DNA, 6246 bp, Homo sapiens
cgcccggtggcagctgtggggtctagggctcagacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctgaaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtactttagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttcttt

SEQ ID NO: 30547 - DNA, 2201 bp, Homo sapiens
cgcgaggctttgcagtggctgcttggcttggcagtggtcgcttggcttggcgtggcagtgatcgcttggcttggcatttctggcttagcggtcctcctttcgcagattggaaaccgcgggctatcctgctgggaggttgtggccgaggcagtagctcgctactgatggtctcctggggtggagaaaagcggggaggggctgaggggtctccgaagccggcagtctacgccacgaggaaaaccggtagcgtcaggagccaggaggaccagtggtacttgggctacccgggggaccagtggtcctcgggcttctcctacagctggtggaaaaacagcgtcggcagcgagagcaagcacggtgagggcgccttagaccagccccagcacgatgtccgcctggaagatcttggcgagctccacagagctgcccggtcgggcgacgtccctggggtggagcacgtcttggttcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggggttgtacttctctcagggaatgatactctccatgacctgtgccaatcacagctaccagaaaacaaagagagcaaagaagaacaagacttggagctgacatcagaggaagagcaagaaagacttaaaggatgcgaaaataagcagccacaaaaaacgtctcaagaaccagaaatggctaaggattgtgatagagaggatatacctatatatccagtacttcctcatgtgcaaaaatctgaggaaatgcggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtgaaggatattccctttaatttgacaaataacatacctggttgtgaggaagaagatgcatctgaaatatctgtctcagtggtattcgagacatttcctgaacaaaaagaacccagtctcaaaaatatcatccattcatactaccatccgtactctgggtcccaggaacatgtttgccagtcatcttctaagcttcatttacatgaaaataaattagactgcgacaatgataacaaaccaggcattggacatatttttagtacagataagaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatggagagcatgacaggtaagcctatagcagcgtttaacaggagacaattggtcaagtgtggtggctcacgcctgtaatccagcaatttgggaggccaaggtgggtgaatcacctgaggtcaggagttcaagaccagcctgaccaacatggataaaccccatctctactaaaaatacaaaattagccaggtgtagtggtgcatgcctgtaatcccagttactcaggaggctgaggcaagagaatcgtttgaacctgggaggcgggggttgtggtgagccatgatcatgccattgcactcgagcctgggcaacaagagtaaaactccatttcaaaaaaaaaa

SEQ ID NO: 30548 - DNA, 2813 bp, Homo sapiens
tggctgcttggcttggcagtggtcgcttggcttggcgtggcagtgatcgcttggcttggcatttctggcttagcggtcctcctttcgcagattggaaaccgcgggctatcctgctgggaggttgtggccgaggcagtagctcgctactgatggtctcctggggtggagaaaagcggggaggggctgaggggtctccgaagccggcagtctacgccacgaggaaaaccggtagcgtcaggagccaggaggaccagtggtacttgggctacccgggggaccagtggtcctcgggcttctcctacagctggtggaaaaacagcgtcggcagcgagagcaagcacggtgagggcgccttagaccagccccagcacgatgtccgcctggaagatcttggcgagctccacagagctgcccggtcgggcgacgtccctggggtggagcacgtcttggttcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggggttgtacttctctcagggaatgatactctccatgacctgtgccaatcacagctaccagaaaacaaagagagcaaagaaggtaacaaagaagcatagagaattcagtcctagagtgcctctgcttggctgcatagagctatagttctgacttaaaaaaactttttctggtaaaatgtgctttgtgtttactcaccttttgcactgaacagaataccttttggcaggatatttgtgttcttcctttaaccaaagcaacatctagataacagagaattaggggaaagcaggattttctttaggaagtaggattatatttagaatatagggactaagtatgtttagggactaacataggattatatttaggataacttagtagagacctaaagattgctgactcaaacacaatgtggtttctttgctttatttttacagctctgaattcacagctgttagttataactatatgcactataatttaaaagacaccttcccacacctgcaatctcagcactttaggaggccgaggtgggtggatcacgaggtcagtagttcgagaccagcctggccaatatggtgaaaccccatctctactaaaaatacaaaaaaaactagccaggcatggtggtgaatgcctgtagtcccagctactcaggaggctgaagcaggagaatcgctggaacccagaaggtggaggttgcagtgagccgagattgcgccactgcactccaacccgggcaatagaggaagactccgtctcaaaaaacaaaaacaaaaacaaaaaaacaccttccaaaagcaaatattaagtgacttcctatcgtttctatgactttatgtattatagaattgactttccaagtcagtaattaatgagacttattgagaatttgctgcatagtatctccttggctgtgtccacatgagctaccaccttgcgttaataaatgtgttcgctagggatgttggttttggcattgacagtgttctatcaccaatgcaaataagaccagggaccactcttgagaacattaatgtccaagcatcttaaagttatacgtaaggctttcataatgtgattctgctcagctctccatctttagccctttcccccgtgtgccccttctctggccttactgaactgctggtcctgtcctgctgacccatccttcgactgcaggcaaacacatacactctttcaggcctctttctgccttttgttgctgcctgtcatgctctcactctttcctgtcccctaccccttctaattaggctagcctcactctttaagcctcagctcgggcaggatctctagaaaagtcatctctgacatgctttcttttcactctttaaatcctagtgcctagcacatagcaagactcaatacataattgctgagtaaaatagataatgactctttgtacaaagatgattttcaagattgttccctacagtcaaggagcagagggaatagacatgtaaagcaataattgacaattcgggtggtggagatgcagtagaaaaatcagtaaagttctagggcagccctaaggaaggagatacctagatacctgtttacctggggaaagatgaggatgagggtcaacttcacctagcagtctgttttttattttatgtattttatttatttatttttagcagtctgttttaaaagatgaaaatattaatacatttgtcagaataatacagggaaccatttcggatgttaggaagaggttgtacaccaataaaggtgtccacagtcattttggaaatcattaataaggtactattatgaaatggagaacagtatgcagcattgcctgataatattgctactgcattccaaaattttgttttgtttgtgatggctttgttcattgatgttgggtggatgaatctgtgagtgaatcttcaacatgattgtatttctttaacctggtggcatctagtgtctcccagaaagtggtttgttgaagttttggagaattagaattatttcttaaagaagtaagtattccactaaagatcaagcttcatttaaactctcaatttatgaaataaaatgaaatgtaattt

SEQ ID NO: 30549 - DNA, 3395 bp, Homo sapiens
gcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacatcagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaagtccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattaaaaaaaaaaaaaaaaaa

SEQ ID NO: 30550 - DNA, 4569 bp, Homo sapiens
tcttgttgttacgggtaacggaagtgtggcggcgttgggttgagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatt

SEQ ID NO: 30551 - DNA, 6586 bp, Homo sapiens
ctggggagccggcgctggaggtggtgagtggcgtggggactgtgtcgagggggtccccaaggtgccggaccctgcggaggggcgaagtttcggcactggggagggcgtgcggacgctttccctacaggcgaccactgctctgcgggcgggtggtcttagctccagtcccccattcagttcctcagcattccaggtcggcggcgaaggggtccccgaacgaagggcgcaaggcagcgtctctgctgggaccgggaagccggacttcagggcctctcggcccgtgggcttctccccgagtctccccgagtcggttggcattaagagtttagcagatactttcagaaatggatacataagaaatggctggaaatcaaatgaatgtccaaagaagagcttagggtcttagtaacattcttttttaaaataactgtctgccaaaatgtcattacacagtactcataatagaaataacagcggtgatattcttgatattccttcttcccaaaatagttcatcactgaatgccctcacccacagtagccgacttaagctgcatttgaagtcggatatgtcagaatgtgaaaatgatgatccattattgagatctgcaggtaaagtcagagacataaatagaacttatgttatttctgccagtagaaaaacagcagacatgccccttacccctaatcctgtaggtagattggcacttcagaggagaactacaaggaacaaagaatcatctttgcttgttagtgagttggaagacacaactgaaaaaacagcagaaacacgtcttacattacaacgtcgtgctaaaacagattctgcagaaaagtggaaaacagctgaaatagattctgtcaaaatgacactgaatgtgggaggtgaaacagaaaataatggtgtttctaaggaaagtagaacaaatgtaaggattgtaaataatgctaaaaactcttttgttgcctcttctgtacctttagatgaagatccacaggtcattgaaatgatggctgataagaaatacaaagaaacattttctgcccccagtagagcaaatgaaaatgttgcacttaagtactcaagtaatagaccacccattgcttccctgagtcagactgaagttgttagatcaggacacttgacaacgaaacctactcagagcaagttggatatcaaagtgttgggaacaggaaacttgtatcatagaagtattgggaaggaaattgcaaaaacttcaaataaatttgggagcttagaaaaaagaacacctacaaaatgtacaacagaacacaaactgacaacaaagtgcagcctgcctcagcttaagagcccagctccatcaatactgaagaatagaatgtctaaccttcaagttaaacaaagaccaaaaagttcctttcttgcaaataaacaggaaagatccgcagaaaatacaattcttcccgaagaagaaactgtagttcagaacacctctgcaggaaaagaccccttaaaagtagagaatagtcaagtgacagtggcagtacgcgtaagacctttcaccaagagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgatgatgggatttagtgaagaaccaggaataattccaagattttgtgaagatcttttttctcaagtagccagaaaacaaacccaagaggtcagctatcacattgaaatgagcttctttgaagtatataatgaaaaaattcacgaccttctggtttgtaaagatgaaaatgggcagagaaagcaaccactgagagtgagggaacatcctgtttatggaccatatgttgaagcactgtcaatgaacattgtcagttcttacgctgatatccagagttggctagaattgggaaataaacaaagagctactgctgctactggtatgaatgataaaagttcccgatctcattcagttttcaccctggtgatgacccagaccaagacagaatttgtggaaggggaagaacacgatcacagaataacaagtcgaattaacctaatagatctggcaggcagtgagcgctgctctacggctcacactaatggagatcgactaaaggaaggtgtgagtattaataagtccttgctaactttgggaaaagttatatctgcactttcggaacaagcaaaccaaaggagtgtttttattccttatcgtgaatctgttcttacatggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaagagtgtggaaagaaaagtttgaacaagctgaaaaaagaaaacttcaagaaacaaaagagttacagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattgtactatcaaaaattttggtgggacagtgagtattatcccagttggggaagcaaagacatatgtaaatggaaaacatattttggaaatcacagtattacgtcatggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacaacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactgagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggagacattggctacaaaacaggctttagaagaccatagcatccgccatgcaagaattctggaagctttagaaactgaaaagcaaaaaattgctaaagaagtacaaattctacagcagaatcggaataatagggataaaacttttacagtgcagacaacttggagctctatgaaactctcaatgatgattcaggaagccaatgctatcagcagcaaattgaaaacatactatgtttttggcagacatgatatatcagataaaagtagttctgacacttctattcgggttcgtaacctgaaactaggaatctcaacattctggagtctggaaaagtttgaatctaaacttgcagcaatgaaagaactttatgagagtaatggtagtaacaggggtgaagatgccttttgtgatcctgaagatgaatgggaacccgacattacagatgcaccagtttcttcactttctagaaggaggagtaggagtttgatgaagaacagaagaatttctggttgtttacatgacatacaagtccatccaattaagaatttgcattcttcacattcatcaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataacttgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggaggaattcatggatgctgtttgtgatggtgtaggcttaggaatgaagattttattagattctggactggaaaaagcaaaagaacttcagcatgaactctttaggcagtgtacaaaaaatgaggttaccaaagaaatgaaaactaatgccatgggattgattagatctcttgaaaacatctttgctgaatcgaaaattaaaagtttcagaaggcaagtacaagaagaaaactttgaataccaagatttcaagaggatggttaatcgtgctccagaattcttaaagttaaaacattgcttagagaaagctattgaaattattatttctgcactgaaaggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggtgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataagtaaataaataaataaataaaatatcttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattatggaaatagtttgacgtttttgacctcaagagtatgtataatttgaagagatactttgtaactatgcttgggtgatattgagcagttcctaaagaataattcattt

SEQ ID NO: 30552 - DNA, 6817 bp, Homo sapiens
gcgcggcgaagctgcggccgcgacttggcgaggtggtccctaacgttgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaacaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcagcgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatctggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattattttaaaaaaaaaaaaaaaaaa

SEQ ID NO: 30553 - DNA, 2150 bp, Homo sapiens
ctcgagccacgaaggccccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaaaaaaaaaaaaaaaaaaaaaaaaaaaaaaaaaaaaaaaaaaaaaaaaaaaaaaaaaaaaaaa

SEQ ID NO: 30554 - DNA, 1621 bp, Homo sapiens
caggttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgagcaactgcaactggttctgcgagggctccttcaatggcagcgagaaggagactatgcagttcctgaacgaccgcctggccagctacctggagaaggtgcgtcagctggagcgggacaacgcggagctggagaacctcatccgggagcggtctcagcagcaggagcccttgctgtgccccagctaccagtcctacttcaagaccattgaggagctccagcagaagatcctgtgcagcaagtctgagaatgccaggctggtggtgcagatcgacaatgccaagctggctgcagatgacttcagaaccaagtaccagacggagcagtccctgcggcagctggtggagtccgacatcaacagcctgcgcaggattctggatgagctgaccctgtgcaggtctgacctggaggcccagatggagtccctgaaggaggagctgctgtccctcaagcagaaccatgagcaggaagtcaacaccttgcgctgccagcttggagaccgcctcaacgtggaggtggacgctgctcccgctgtggacctgaaccaggtcctgaacgagaccaggaatcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacagtcaatgccctggagatcgagctgcaggcccagcacaacctgcgatactctctggaaaacacgctgacagagagcgaggcccgctacagctcccagctgtcccaggtgcagagcctgatcaccaacgtggagtcccagctggcggagatccgcagtgacctggagcggcagaaccaggagtatcaggtgctgctggacgtgcgggcgcggctggagtgtgagatcaacacataccggagcctgctggagagcgaggactgcaagctgccctccaacccctgcgccaccaccaatgcatgtgaaaagcccattggatcctgtgtcaccaatccttgtggtcctcgttcccgctgtgggccttgcaacacctttgggtactagataccctggggccagcagaagtatagcatgaagacagaactaccatcggtgggccagttctgcctctctgacaaccatcagccaccggaccccaccccgaggcatcaccacaaatcatggtctggaaggagaacaaatgcccagcgtttgggtctgactctgagcctagggctacttgatcctcctcaccccaggtccctctcctgtagtcagtctgagttctgatggtcagaggttggagctgtgacagtggcatacgaggtgttttgttctctctgctgcttctacctttattgcagttccccaaatcgcctaataaactttcctcttgcaaagcagacaaaaaaaaaaaaaaaaaaaa

SEQ ID NO: 30555 - DNA, 6297 bp, Homo sapiens
agaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagtaacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagaggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttctttttagcccttttgtttggtctatcagtataagaagaatattttaggtttatagctgaagttatcaaggtttaataaagtaaatttctaaca

SEQ ID NO: 30556 - DNA, 3806 bp, Homo sapiens
gcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccctggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcagtttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatcaaaaaaaaaaaaaaa

SEQ ID NO: 30557 - DNA, 3789 bp, Homo sapiens
tgtgtttcggtgtgtaacgcataaaacttcttgttccacgctccgcggtgttggggattttctactgcatctcgacagcatctcgggtaacaaccgagcccctcctcgcagcgttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccctggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcagtttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatcaaaaaaaaaaaaaaa

SEQ ID NO: 30558 - DNA, 2032 bp, Homo sapiens
cgcctggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaaccactccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgccgggtccttttcactgtcggtccgggacttcgaccaaaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtgcatgtgtagcctgtgcatgtatgtcttggacactgtacaaggtacccctttctggctctcccatttcctgagaccaccagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgccg

SEQ ID NO: 30559 - DNA, 2032 bp, Homo sapiens
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 30560 - DNA, 3181 bp, Homo sapiens
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttct

SEQ ID NO: 30561 - DNA, 3091 bp, Homo sapiens
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttct

SEQ ID NO: 30562 - DNA, 4470 bp, Homo sapiens
aattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccacggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacac

SEQ ID NO: 30563 - DNA, 4262 bp, Homo sapiens
ctcctaactccactaagtacagaagtggagccgtacagccatgaatgtcaggcatgttgtggggactagttgtattagttttctattgccaccataacaaattaccacaaacttaagcaatatagtacaaatttatcttaaagttattggcaggtcagaagcctgatacggatctcattgggctaaaacgaaggagttggcagggctgtgtgttcctttctgtaggctctgggcaggatccatttcctgcacttttttggcttttggaggtcgtccacattccttggctcctggccctgctccttcatcttcaaagctaccaaagatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacac

SEQ ID NO: 30564 - DNA, 1733 bp, Homo sapiens
ctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttggcaggtattgctgtctctaagccagatctggtcacctgtctggagcaaggaaaagatccctggaatatgaagggacacagtacggtagtcaaacccccagtagagacggggtttcaccgttttggccaggatggtctctatctcctgacctcgtgatccgcccgcctcagtctcccaaagtgctggtattacaggcgtgagccaccatgcccagcctaataaaaatttttttatttctattgtatccaatagcttgttttaagtgtgtagaacaataacttacacttttatgttaattttatattttgttaatttactgactgtattattagtttagacaaatttcaatgtactgtggttttttatgtgtaagattatatattcctcaaacagcaactttttacttatttgtcttcagtttcaatggctttaaaaagaattcttttttcattattctgccacatgcttccagtgctatgttaaaatagaaacattgacaaagggcacaatagagtttactattggtgtctgtgaatttgaaatggcaaacaactccttaagtttttataagctgatttcaggaggtaaagatcttcttttcttgtgttccccagggttttgggatgccctctgggtttgtagtggagtggggttgtaacttggttgcaaggctgctggttctacattagggtccatatttagttgtcatgttacaagaggcttgggtagttgtacttcccaatttttttttttttttttttttttttttgagacaggagtctcgctctgtcgcctggctggagtgcagtggtgtgatctcagctcatcaaaacctttgcctccctagttcaagcgattttcctacctcagcctcctgagtagctgggattacaggtgcccaccagcacgcccagctaattttttgtgtgtttttagtggagacggggtttcaccatgttggctaagctgggtctcgaactcctgacctcaggtgatccacccgccttggcctcctgggtgctgggattacagacgtgagccaccacccccggccacttgtttcttttaaatgcttattaaaagtttctcatcagaatattttatttataattatactgcatattctctgaaattttactgccaatttttcaaaatacctgcttttgatgagtacagttacagtcaaatactgtagttagacaaattcttttttaatggtatattaatgttgcataccaaattgtatgagttaaacgtctcttcctgtgcagtttcatattagtggtgttttcagtgtaggtatcttaatatcagcttatcgtggtttttggttatgtattataattttagtcaatttgcaattctgtctgtatactttatgtcaatgtgaggttgaattaaaagatagccatatgtctatcacaaaaaaaaaaaaaaaaaaaaaaaaaaaaaaaaaaaaaaaaaaaaaaaaaaaaaaaaaaaaaaaaacctcggg

SEQ ID NO: 30565 - DNA, 1965 bp, Homo sapiens
ttgctgcatgccttcattcctggtgccctctcttgtctcttccccagtcctgctgaagctgctctttagcccaggccccaagactatatggtccctgtggcagcagccaatgttgtttcaggaagcaacagcatttgaaaatatgaccaaagattggaattatttagaaggctctcaaaaggattgctacagagacacaatgctggacagttatgagaacacggtcccacagggatccttcttacagctctccatgatgcctcagagagctggaaatgatccacctggggtttcaaatgcaagtgaaatggaaatggagataagtaacatgagagaaaagtttcttatgagtgtaacaaagttagtagaaagcaaaagttacaacagcaaggtattttccaaagaaaagtactttcaaacaataaaggaagttaaagaagctaaagaaaaagggaagaagtcatcacgtgattatcgccgtgcagcaaaatatgatgtgatctctgtacagggcacagagaaactgatagaggctactcatggagaacgtgatcgaatacggtattatgtacataaggaagagttgtttgatattcttcatgatacacatctcagtattggacatggtgggcggacacgcatgctcaaggagctgcaaggaaaatatgggaatgtcaccaaagaagttattgtcttatatctgactctgtgtaaacagtgccaccagaagaacccagtacccaagagaggccttgcaccaaagcccatgacttttaaggacatagactccacatgccaagttgaaatacttgacatgcagtccagtgccgatggtgagttcaagttcattttatactaccaggatcactcaaccaagtttattattttacggccattaagaaccaaacaggcccatgaggtggtcagtgtcttgttagatattttcacaattcttggtacacccagtgtgttagactctgacagtggcgttgagttcacaaaccaggttgttcatgagctcaatgagttgtggccagacctaaagattgtatctggtaagtaccaccctggccaaagccagggctccctggaaggagcaagccgtgatgtaaagaacatgataagtacctggatgcagagtaaccactcatgtcactgggccaaaggcctccgattcatgcagatggtgaggaatcaggctttcgacgtttccttgcagcaaagtccatttgaggcaatgtttggctataaagccaaatttgggctatattcctcaaacttgccccgggaaactgtggctactttacaaacggaagaagagctagaaattgctgaagaacagctagaaaatagcctttggatcaggcaggaagaaagggctgagattggagcagacagatctgatatggacgatgacatggatcccactcctgaagcttcagaacccagcacctcacaagggacttccggtctcctctgctggtgaacagatggctgctgggtggacagtcacaggtgtctctctgagcatagtcatctgagaactgttgccagaggccccagaggaaaagattgaaggctgcactctcaggtcaagttgtacatggcagtccttgctcaaaaagacaaaagttcaggtctgtgtatttattcttagggctgccataaaaaattaccacaacctggccgggcgcagcgctcatgcccgtaatcccagcactttggtaggccgaggtgggcgggtcacttgagatcaggagttcaagactagcctggccaacatgatgaaaccctgtctctactgaaaatatagaaattggccaggcttggagctgtgtgcctgtaatcccagctaaccaggaggctgaggcaggagaatcacttgaacccgggaggcagaggttgcagtgagccgagaccatgccactgcactccggcctgggtgacaaagcaagactctgtctc

SEQ ID NO: 30566 - DNA, 4413 bp, Homo sapiens
agatccttccttctctcctccttcttcattctacaccacccccaacacatatccctgcaccccgcccattctttgctctctctcctttcttacacttaactccttcttgctccacagcctaacatgctgattaacaggaccccaaaggtttgggtgggtattaggggccttctcaacaaaagcagcacactcttgagcttgttcttccttttgttgccatctcagataaaaaggccccatgagggaggagacagataagtatagacttggtattctgataactctgtgttacatgggatcagatgtaaatgagttgtaccctgtggtgtttcatgctctgctgtgttgtcttctcatggtgagcttttctgtgcccttatttcatccagctctggtttctgtgtttcatgttatttctcctagcctctgtaaactctgcagcatactaataatgctctggctttctgattaaagataaatggcttactatcatcacccctggcttgagggccagctcacatgtaatcccttataggattccaaagttgttaaataaatgcagttctttttgtcattttgaagcattcaaaaatttttcaagaaaagctatgatcatataaatagaaattttatccagaatgttacagtgtagcatttgtgaataaatgtgtaggtgctgtatttgctcagactctagtttgggttgtgttttcttttccctttttttttttgagacggggtctctctctgtcatctgggctgcagtgcagtggtgtaatcacagctcactgcaacctctactcccaggctcaagcaatcctcctgagtagctgggactggagacatgcgccacaacgcccagctaatttttaggtttttctttcacatagacggggtctcactctgttggccaggctggtttcgaactcctggactcaagcagttccccccacctcagcctcctaaagtgctgggattacaggcctgagccaccatacccagcaagttatattttctttttccttatatagagtaaaataagggtgagtgaccgagaggttgatgcatagctagatcaccagtttaaatgccttcccacacacccctttcctcctgttccctccacctacaggttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgagcagatctgtgagctggctgatgccttgagtcgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctttaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 30567 - DNA, 11128 bp, Homo sapiens
ttgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccacggcactcagctaatttttgtatttttcgtagagatagggtttcaccatgttgcccaatttggtctcgaactcctgagctcaagtgatccgcccgccttggcctcccaaagtgctgggattacaggcatgagccaccgtgcctggccagaaaattgtaaacacacacaaactctcaagtggcctaattccctctcaccaaaccaatcacaatacagataaaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcagccacctgagtagccgagaccacaggcacgcactaccatgtccggctaattttgtatttttaatagagacagggtttcaccgtgttggccatgctggtcttgaactcctgacctcaaccgatccgcctgccttggcctcccaaagttctgggattacaagcgtgagccacagcgcccagccttattataattgttactatttaaatctcttttgctctctccttcaagagagacctcatcccattcagttgcttccatttatttattcatcttctgcctcctgggctcgagagatcctccagcgtgagtctcccaagtagctgggactacaggctcacaccaccaagcttggctaaattttgtaggttttggagagacaggctcttgccacgttgcctaggctggtctcaaactcctgggctcagatgatccacctgccttcgcctcccaaagcactgggacatgagccaccacgcccagccgcaagtacttttacacaaaatgcaaacaccattcttccatcataaaagtgataccacagcttccgtgaagttttgccaggtagtactcataattaccttgggtaaactttttgatgttaaactgtatcttcttattacgagtttttccattgtattaactgcttttacaacaacacaaataacaagttattttacaaaccatttagaaatttctgtactatggtcccagtaatgtaaaatatattaatgcctattacattcagataaattatacacttggaaaccacatacttatgacttacagaaacttacataaacaaattatagaaattacatgctcaatttttaggtatatagtcttaaattaagcttaaatatacattctcaagataaattaacagttcagggcttcacaacttgaaatctgtggaagatgacattggagacaacagaactctggtggaattcttagatggaatttgccgaaacttttttttttttttttttttgagatggagtgtcgctctgtcgcccaggctggagtgcagtggcgcaatctcagctcactgcaagctctgcctcccgggttcacgccattcttctgcctcagcctcccgagtagctgggactacaggcgcccaccgccacgcccggctaattttttatatttttagtagagatggggttttactatgttagccaggatggtctcgatctcttgaccttgtgatctacccgccttggcctcccaaagtgaaacttttctttaaaatagagatgggatcttgctgtattgcccaggctggtctcagactccttgccttaagcagtcctcccacctcagcctcctaaagtgctgggattacaagcgtgaagcattacatccaagtgaaacttcttgagatggttacataatgtctaaatctgctggtgtagaagttaataaagtgtagaactgaataactattaaatattagatcaagtttctcatgtttatcttaacgtataacgatttatcttaaagcactgattttcacaaaataacatcagtgtgaaattggaaaagaagccaaatattttatttcatgtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcacgcctataatcccagcaccttggaaggccaatgagagtggatcagttgaggccaggagtttgagaccagcctggccaacatggtgaaatgccgtctctactaagaatacaaaaatgagccgggcacggtggcacgcacctgtaatcccaggtactccgaaggatgaggcaggataattgtttgaactcaggaggtggaggttgcagtgagccaaaatcatgccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30568 - DNA, 10307 bp, Homo sapiens
attgagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30569 - DNA, 8185 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagatcaaccacatccttcaaaaggactatgcctgtttataagcccagctgtttctgccctgtgaaacacggaaaatgtttcaacgtgcgcaagagttgc

SEQ ID NO: 30570 - DNA, 8616 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggttcaaaattgagtttgtcctttctgcttcattagtttaagctgtataattcctttcccttcctacattcttgttttcattttttcggaggaagaggagttgctagtactggcattggttttcctttctctttttttttttttttttttcctgagatggagctttgctgttgttgcccaggctgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccaggctggtctcgaacttctgacctcaggtaatccacctgcctcagcctcccaaagtgctgggattagaggcgtgagccaccac

SEQ ID NO: 30571 - DNA, 9342 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagccgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaat

SEQ ID NO: 30572 - DNA, 8562 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagttgtctgctcactccccttccaccctcagctctaccctcagctcc

SEQ ID NO: 30573 - DNA, 10317 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30574 - DNA, 9949 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataa

SEQ ID NO: 30575 - DNA, 10277 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30576 - DNA, 11320 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 30577 - DNA, 10487 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30578 - DNA, 10378 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30579 - DNA, 11778 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 30580 - DNA, 10945 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30581 - DNA, 11453 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30582 - DNA, 10871 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagccgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaat

SEQ ID NO: 30583 - DNA, 12571 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 30584 - DNA, 11913 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30585 - DNA, 11575 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30586 - DNA, 12496 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactggctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 30587 - DNA, 11663 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactggctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30588 - DNA, 11606 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30589 - DNA, 11738 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgttggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 30590 - DNA, 1415 bp, Homo sapiens
ggggaagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaaccaaaaaaaaaaaaaaaaaaaaaaaaaaa

SEQ ID NO: 30591 - DNA, 3110 bp, Homo sapiens
atgcatatttgtaaagctttacacccaagaatggtcctaccctgcccaggtttctgtggcacctctgtgattccaaatcagcgatcaggtgggcagcggtctgggcagtcacccacagggagtacacttggtgctgcacgttcggactttcagtcttgctcaaagcaaagaatctccaagagcgctgaggctacggattcattcgggtggggcgaggtgttattattgtgggattgtctctgcagagttggcctggagagtgagcggtggagggagtggaacaaggcttcgtcaagagtccccaggagtccaggggcgcccccgagacggtggcgcagaggcggcgacactggcaggcgtccggctgccgccacctcccgggtgtggcgggtctggggcccggggtctccggccagagcagctgtggagccacgtgcaacacgcgcgttgccctcagcccgggcggggaccggacgcatccggagctgcggggaggagccgggcgccgcccccggcggcagtgccagccgcgtgggagggcacggaccggcggaggggcagacgacggaggcggccaagctggaggaacgggaccgagggatcgaccgaggctggctggctaggggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccagcagcagcaggggcagcggggacacaagccgcgaccgagccgccgccgcagccctggctgccacagctgtgtgggatcccagccgacactgcagaaagctccttttactagcagttaaataaatcgaccaaaaacaaaacaaacaaacaaacccaacaacaacaacaacaacaaaagccaagccaaaagccaaaacaaacaaatccagccaaatcaatcattgagaaacaataatattaataaaatccaaaactaaatcaaaccaatcaaggcaccaagacgcaggggggatatccacagttcgatcaaggtaataatcaaggtcttccgacgtgaacattgcacgccttttgtggatttttagaattccttctttctttctgccatatatctgtctgtttcttttgaattttttcttgtctgtatttcttcttcgtgtttgtagaaagctgatgttgttatacatgtattgtgttttttatgtttcgtcaaggagggatggacgctccttcccccagaaaagacagaaatggaaagctggaagttggcaatgattttcatcagagaagtctacagtgatttgtataggctttatggtagaaagtttgcaatgctctttttgaaagagacctattgaagaggtagaaagttatactctgtttgttgtcctggaaggattggggtcctaggtcccaaagggctcaaggggaagaatagaaaagatgttcagttttatttttacatgcatgaaatctgtgcttcattgcaatcgccaatttactcttttctgtctcaggttgtagatatggtggtagaattgagttgaattaggcaggtgtttagaaagtttcttaggaataggaattaactcattcaatgtttatgcatagaaatatagctgaggtggatgtggttgctgtcagctattcaggtttgctacctgatcacctcctgaagatgtagggtaaggacagaatccaagcctaaaagaaaaaacaaggagagaattgaaagttataggggtgggcagttatatttcttaaaaggctggtagaaatcattttcctaagaatgtgtttagagtacagatattcattttaatctttgatttctttaagttttttgatgtttgattttctaccagtatgacactcagcctctcaaaacaagaaggacattccccaaagttgaaatgaatctgtataagatttcattcaaatgcagaataaattcaaatgattcctaacccctcctcatctactttggagataaaaactgctatgattgttttaagtaaacagagaagtggagatgacaggaaatcatttttcatttgttaaaaatcagaaaacctttgacacacttttagataaatacacctactcctttgatcctttgtgtatgtattaccacagggcttaaatatcttaagattttagttaatgtcattttcatgaaagacagtcatttggaagccaagagctctatctatgttttgttcaaatagccgagtaatctactatcttggcagtaattacttctgctgcatttctaatgtgaattgcatgtgagagcttatgaatacactcttttcaagtgtatgtgggttttcaaggtatgtatttgtgtttgatcctatatttcctttgttataacattctgcttttcatcactttgacagaatatttgtaaattttctggagagtgagtttgggtatatgctttgaggaatatgcttcctcattacaaaagatatggaaacataattgattactacacttgcttatcaatagtattttgattttgtttaaatgaaatgtttaagatacgtggattgctatgcattcatgttttagatttatcctctccaggcatgatttatgccattcaataattaaaataactaagttactttagaaaaagtgcctattaaacagagtactttgtttagaggacgtatatttaaataaacttatacagctaaaga

SEQ ID NO: 30592 - DNA, 576 bp, Homo sapiens
gcaacaagaagctagggcagaggatttagagggcaagcaagcatgggccaggactttgacagcattcatccagcagcatgcgaactccaaagagaacccgatctccaaagacaaaagtgagcctgaggggagaaaccttgactctccagttgaccactgtgtctctcgacacacggcatatggtgaaacggtgtgatgagaggcatggaaggccattacctcattcacaggaatctcagcatggctctgcaacttcaaagaaggcagttcggggaacagcagacacagctcctttggaaagaatatctgccgcccgaggatgggctctgcctatggaggcaacagtgagtgtcttcagagcccatcagtggcagtggaattaatgaagaaagcaatggcaggaaaagttgaataaagcagacccttcatggtaaatctggttggtaaattgcctgtgaccacatgtgggacaatcactggaggaaccccagttacatttggtcagagtgtggcgaggggaaccttctcaggaaagaaaatagaggtcctgttttaggaaaaaaaataaagatcaga

SEQ ID NO: 30593 - DNA, 1115 bp, Homo sapiens
gctggcgacactaggcgcactgaagcccgagccgagccgagcccgagccgccgccgccgccgccgctgctgcgcaccgctcccgggctccctcccagcgcgccggccggggtgtggggggcggcgggccggaggggcgagggcgggccagggggcgcacacgggggttggcgcggaagacaggaccctcagcctcgagggagcccctaggtgaccaggcaaaatggcagttccttccagctggtcctcagatgggcacatctattagcctctgctcttgtaagaagttagctgcagaacccacatgtgaatccttgtaggactctggagaagatcaaatgggagcttagatgtggaagctctttggaaaccaagaaacactctgaaaatgaaaagggaacagtttgtggacttgcgctggcccttggaccacacttcgagtgacattgttatagatgacacggtctcttataggaaaatgcacagtctttcttagattctctacctccctcttccatctcattcccaacatagatctgggtacatgagtggggtcttattataatcttgtgacacccttggatcatgcactaccctctaaataatcaatagtttctactatagagaggctcaatttatcttctccctggaattgggaccactgaaatataactagaacccaactgatcttttgagatgttgtgtgcttgcccttactgctactgccgtagttctgaacatttccccaagcatcaaaaaggccccatggcctcttttcccctagacctctgccagtccaccaacactctcagtggggaagtaagaagcctggtggatcctgcttcccacacaaaggccatgatgagacagatgctttctaagtccgatatatctacccactttctgctgtcacctctgtacctcctgagtcacatggaatgtggtgctgagccaaatggtcagtcttctagaagcagtggaatgttggaggcagcttataccttagctgattcttaaattttcaggaattttgtgagccagtttttaaacacagccattgttgaaaattaaacaatataaacttataatcaaatatattaaaaataaagataatgc

SEQ ID NO: 30594 - DNA, 1546 bp, Homo sapiens
ccccttttgtctttcatctgtttctggttcattggctgggagttgcacctgcgggaggacgtctcatgcagacttgcacatatacagggagtgttgcattgaaggtctttgctggaccttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgccttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacagttgaagtacctcgctttcctccgcaagcggatgaacaccaactcttaccgaggctcctaccacttccgggcccccagccgcatcttctggcggaccgtgcgaggtatgctgccccacaagaccaagcgaggccaggccgctctggaccgcctcaaggtgtttgatggcatcccaccgccctacgacaagaaaaagcggatggtggttcctgttgccctcaaggttgtgcgtctgaagcctacaagaaagtttgcctatctggggcgcctggctcacgagtttggctggaagtaccaggcagggacagccaccctggaggagaagaggaaagagaaagccaagatccactacgggaagaagaaacagctcatgaggctacggaaacaggccgagaagaacgtggagaagaaaattgacaaatacacagaggtcctcaagacccacggcctcctgatctgagcccaataaagactgttaattcctcaaaaaataaaaaataaataaaaata

SEQ ID NO: 30595 - DNA, 1641 bp, Homo sapiens
ccccttttgtctttcatctgtttctggttcattggctgggagttgcacctgcgggaggacgtctcatgcagacttgcacatatacagggagtgttgcattgaaggtctttgctggaccttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgccttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacaggtactgctgggccggaaggtggtggtcgtacgctgcgaaggcatcaacatttctggcaatttctacagaaacaagttgaagtacctcgctttcctccgcaagcggatgaacaccaactcttaccgaggctcctaccacttccgggcccccagccgcatcttctggcggaccgtgcgaggtatgctgccccacaagaccaagcgaggccaggccgctctggaccgcctcaaggtgtttgatggcatcccaccgccctacgacaagaaaaagcggatggtggttcctgttgccctcaaggttgtgcgtctgaagcctacaagaaagtttgcctatctggggcgcctggctcacgagtttggctggaagtaccaggcagggacagccaccctggaggagaagaggaaagagaaagccaagatccactacgggaagaagaaacagctcatgaggctacggaaacaggccgagaagaacgtggagaagaaaattgacaaatacacagaggtcctcaagacccacggcctcctgatctgagcccaataaagactgttaattcctcaaaaaataaaaaataaataaaaataaaaaattaaaaataaagaag

SEQ ID NO: 30596 - DNA, 1541 bp, Homo sapiens
ccccttttgtctttcatctgtttctggttcattggctgggagttgcacctgcgggaggacgtctcatgcagacttgcacatatacagggagtgttgcattgaaggtctttgctggaccttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgccttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacaggtactgctgggccggaaggtggtggtcgtacgctgcgaaggcatcaacatttctggcaatttctacagaaacaagttgaagtacctcgctttcctccgcaagcggatgaacaccaactcttaccgaggctcctaccacttccgggcccccagccgcatcttctggcggaccgtgcgaggtatgctgccccacaagaccaagcgaggccaggccgctctggaccgcctcaaggttgtgcgtctgaagcctacaagaaagtttgcctatctggggcgcctggctcacgagtttggctggaagtaccaggcagggacagccaccctggaggagaagaggaaagagaaagccaagatccactacgggaagaagaaacagctcatgaggctacggaaacaggccgagaagaacgtggagaagaaaattgacaaatacacagaggtcctcaagacccacggcctcctgatctgagcccaataaagactgttaattcctcaaaaaataaaa

SEQ ID NO: 30597 - DNA, 1589 bp, Homo sapiens
ccccttttgtctttcatctgtttctggttcattggctgggagttgcacctgcgggaggacgtctcatgcagacttgcacatatacagggagtgttgcattgaaggtctttgctggaccttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgccttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacaggtactgctgggccggaaggtggtggtcgtacgctgcgaaggcatcaacatttctggcaatttctacagaaacaagttgaagtacctcgctttcctccgcaagcggatgaacaccaactcttaccgaggctcctaccacttccgggcccccagccgcatcttctggcggaccgtgcgaggtatgctgccccacaagaccaagcgaggccaggccgctctggaccgcctcaaggtgtttgatggcatcccaccgccctacgacaagaaaaagcggatggtggttcctgttgccctcaaggttgtgcgtctgaagcctacaagaaagtttgcctatctggggcgcctggctcacgagtttggctggaagtaccaggcagggacagccaccctggaggagaagaggaaagagaaagccaagatccactacgggaagaagaaacagctcatgaggctacggaaacaggccgagaagaacgtggagaagaaaattgacaaatacacagaggtcctcaagacccacggcctcctgatctgagcccaataaagactctaa

SEQ ID NO: 30598 - DNA, 912 bp, Homo sapiens
atgactcatgacaaaaccaccaaaataccctgcaaatcaccaccagaactagtagacactgcaacaagctcaaagaaatggcccagggcttgtggccagaaagtagaagtgaaagaagagctattagcagtcggcaagctcacacaaacatcaggggagaccacgcacaccaataaagaaccagaaggtgagggcaaaggcatgaaagcatttaagcaacctgcaaagcagaagctggacccagaaaatgtaactggcagcaggagattgccaagagtgcccaaggaaaaggcccaacccctagaagatctggccagcttccaagagctctctcaaacaccaggccacactgaggaactggcaaatggtgctgatagctttacaagtgctccaaagcaagcacctgacagtggaaaacctctaaaaatatccagaagagttcttcaggcccctaaagtagaacccgtgggagacctggtaggcaccagagactgtaaaatcacaaagcaaaagcaacacctccctgcccccactgcccttcaagaggggatgtggaaaagatggaagtgtcacaggaaccaagaggccgcactgcatgcctgcaccagaggaaatcatagaggagctgccagccagcaagaagcagagagggttgctcccagggtgagaggcaaatcacccgaacccttggtcatcatgaagagaagtctgaggacttctgcaaaaagaattgaacctgcagaagatctgaacagcaataacatgaaaaccaacaaagaggaatacgaattacaagactcagtccctgaaaataagggaatgtccctgctctccagacgccaaagtaagactgatgtagaacagcaaataactaaggtcattgtattagcagaaagaattcaaataaactga

SEQ ID NO: 30599 - DNA, 912 bp, Homo sapiens; identical to SEQ ID NO: 30598

SEQ ID NO: 30600 - DNA, 1160 bp, Homo sapiens
atgcgcctctcccgaagcctgccaagcaccacaagggtcgccaccagcacagcgacaagaggccacaccggggaccgcgactcccgcgtgtgcgcacacgcagatgcgcccatatgcacacggacgggcgcgctgcggggaccagggctgctcactgcggggcgtgtgtttaactccaatattttaaattataaaagtaaacttggaaactacagcaaacgtgcgtcttcgcggggctccaagcctgggcactggccggctgcgtgcacttttctgtcccacccacccgagcgcacagctcctcacctgaggggcccagtcgcgtcgggcctcccgagggggctgcgagtgtcagtcggctctccgcacgtgtccgcggcctcgcggagcagtccacccctggctggtttctgcttccacctgctgatctcacagagcttgattttgacacaaagcaagatactgaacattaacaccaccacagaggcctactatgtgctcctgtccctgttgttacttcctccaaagtgttggaggaggggccttgtggaaggtgattgaatcacggggacggactttcctgttgctgctcttgtgatggatttctcacaagatctggttgtttgaaagtgtgtagcacctgccacttcactccctctctctcctcctggccatgtgaagactgtgcctgcttcctctttgtcttccaccatgattgtaagtttcctgaggtctccccaggagcagaagcctatacatcctgcagaactgcaagctaattaaatctgttttctttataaattacccagtcccagcactgcaagctatttggcatatgaaggtcttgacctgagaaaaccatcttggataactgcagcaaggaaaaggaaaaatgcaacacctaggagatttcagtaaacagtagaatcatgccaacctaatctgtgttaaaatgcttggaatgtgggagccgctgatgatgcctcttgtctgtgtgtctgactgaatcctttcttttctcagagcagcaaagcaaagcctgggaaccaggccaaatgcctgccacttaccttaaattgatcagccactttgagattaaaacccctgaaagctgccacaccgtgaaaacaaggcctccttcacattaaaggcaaattgcg

SEQ ID NO: 30601 - DNA, 1160 bp, Homo sapiens; identical to SEQ ID NO: 30600

SEQ ID NO: 30602 - DNA, 2876 bp, Homo sapiens
tgcctgaggatggaggaggcggaggtgctgggattgaaggcagaagagaaagtgtgaaagcacccaggaggagaatgaatgagctgatctccagctgcatcctgccagagagcaccgagtggatctgccaaacacagactgctgggcaggcatctgattcagtaggtctgggtggggctcgagaatgtgtatttctaacaagttccaggatgacactaatgccgctggctggggatcccacacttccagatgacactggtctggaggcaggttgcgtggtagcctcaggggctcccgtggtcaccgctggtgagagcgggtggcaggtttgtgcgttccttgccaggcattcagcttgccatttagtttatctgacctgctttttcctgcatgtgggctcatcagccaccctcgagggtacacatagtgacaagctgcagaacattcgtgagtggggacaaaagctgagtggaaatgctggccggggtggctcatgtctgtgaagcatgatctggctggaccttttagaggggccctggcatcagtttctggggttggcagctcctgctgagcaggctcccagccacctgtcctacacagtggcactctgaccttcactctgggcaagagaccatccgttttactttttctagcaaagggcatctgggggctgactgatatctggcctgcctttgagtcagcctcctcactgccagccagaggcatgggatctggggccacgcttccagtgactgacagcggctgggctcagggctcacctattcctccgtcctcccaccacctcactgttcagctgttggtcaacacttgcttcctctgcttttcagcttccccatttgagcggctgtctcctgccctcttgccccaggtctgcctggtctcatggaccctgggagggagcacaagcgtgtgcccggcacaggctgtccctgggcctgcacacagacctgctgcccccatagcctgctgggttcgaggaccagagacaggccggatgtatttaagcccatgagggtttgcatctcagtacttttcctgggactcttcctgagccgtactgagtatacgccgctggcacagtcgtcacacatggagcagaacatccacgcccctcactcctccttgtcctgtgccaaaaccatgttcagggatcaaagaggggcacggaacacacccggatgactctgcttttctgaaattttctcgcatggaattattttgctgatatcttcattttgtgattctatcctatatggaaagcctatattccatcttgtcaaatggaaaagttcacaaattgggaccattttctgtttctaagaccccatagcctctaggttgcttgccggcacagagccgcccgctctgcagatggctgtgtctccacagccttcctggaagaacagcctcaagggctgccagcatcagaaggacatggctggggaggagggaagggggaggaagtgggaactgccatggcctatggtacaactacaaaaccaaaaagccttgcccctctctccgatttacctcccccaacttgaaaagcatgagggcgtcacagacatcatctgctgatgcctgaaactcctgtattccacacccagagacaagcgcacagttaaaagtgcctgggcaggtgagggtgtgattcactcaccatggcaagagtggtctctggcattagaccctctgggttccaatctgggctttgccaccttcaatactgccttatggggttattgggaggattaaataatttgagtaacgcacttagcatggtacaaatgttcaatacatgccacttttagattaaattaaggattaagtaatggacatcagacagttttctaggaaaaaaagttaatcatggaactgcttgcttctgtagctgcgccccatcagagagcagtagcgcacccccaccctcaccccccaggtcattggttctttctgccagacctgccccacttccttggttcttctgggaatagcagtccctcccttcagggaactgctcttcccattcagatgaagcagcttcagcacacacatgcctcacacatggctggctcttctggggagatgtggaatttaatctaaaattagcacattttgagtcatcagtaatgttcccagtggcctactcaagggatatagcaacagggactcctcattctctttattgtaagctctgatacatttaatgcatttaattgcttgagtgcatttcatttctaatgtataataataatatcggccattattgagctgggcactgtgcaaagcacttgataagcatcattgcattcaattatcctgtttggccctattataagcctgtacataggcttctcagacacagtttatgacatgtgaggcggctgagggtgggtagaattgcccagggtcacacagctagagagttgcggggcagaggttccatcagaccttaatttatgagagtggcatccagacatttcaaagtcaaggataaaaaatggaactaatctacattctccgaagggtggaggaagacaggctatgagagtggactggagagtgacatcacagcatcaagagctctgtggacagagagcaaagcaacgccagaagacgtgctaaagtcaaagcattaaattgtgtacacaagctatatattcgtgtcttatagcctgttcaaacaagtgggttgtcagtgtctcaacctgacaaggatctgaaggaataatagaatgcaactggtactgctttgtaccccatcagttaatgagtctaggcactgatcgttggtggctctctgaagacaagcagatgtgcgtaccttctaatggaaatacacaccacttttgaag

SEQ ID NO: 30603 - DNA, 483 bp, Homo sapiens
cagaacatgccagtcacgctgaacatggacatatgaaggaaaatgtaccaaacagcgcagtgaagtggagtgaactctcagttttcagttgctcaccttagattcaaactcaacttcaccatttagcagttatgcaatattaatttagtcaatgaagctctctggatgtctctctgcctttaacattaagagattggaccacatgaatctaaggccacataataactggaacagctcacatcaatgtctgacatcgaatgtgcagagaaataaactcacaggttctctccccagtgggccttcctcaaccagcacctgacgctacctaatacagggtactgcctgccacatacagtggctaactgaattacatgaatacaaatgcctgagcaaatgtggatcgcttggtgcatatccacagggaagccaatctcaaaggaggacttgaaatcaccttcaggagatccagtttcagctgcagct

SEQ ID NO: 30604 - DNA, 1069 bp, Homo sapiens
acgtctacatgcatacttctcttacactgctgctactggaaaagctgaaccccgcgccaggaccccagccccctgcaaggacccgtgagcgtctgggaagctgtctctgggactgaagccccccacctccgccgggctggcggccactgcggtaccctacgccccgtcgggctggtcctgcacaatttgggaaaaagccgcagcgcttctgcaaggtctacgtggccatgagcatgcaacgcttggctccaaaaaagacacgaaaggagcaaagcgccaacgaccacccgatcggagggcccgaggggcgcctcttcaccagtcagctgcagcttaagttccgtgcattatctgaaaggaacagctggctggaggtatccagggctgtcactccaacctctgcagcagtgacctcaactcccagcacttcaaaacccagacagaaacgtccaacaaactcccagtccaggagcgctgcaaaaccaacgccagtctagtttggggtctctataatcctgctcctttggctgccagccatctccataaaaaaagaatttgaaaggcttccattctttcagagacctgtttcccgggactggctgcaagggagagatgcactgaccttctgccaggtatagaactattgaatggtacagtttgagatcttcgaaaccatcaggactgatcattttctggctactttctacataggaatcctagagttccttggagaggatatgaaggttattctcaggccatgcagatgggcaagaaaggatgtgcgtccatggttcctcttcaaatccaaccaaaacagccttgcttccgttggctttatataatactgcaactcttgataatctgatttaacacaaatttcctcattgagtttctcctcatgaagaaacggcctcagtgaggtaaatcggaatgcacaggagcacatagcaggttagtgcagaccagaaatcaaacccaggctttctgactgctcaatagaccacaatctaccatgctaccatggaaactttaaaacagatgaaagtaaaaacaaacaaacaacaactta

SEQ ID NO: 30605 - DNA, 1950 bp, Homo sapiens
tttctgagaggccaggtggcaggatgtgggacgactccagctgacaaagacagtctaaccgtggggtaggggctggagcaggggccagcgacccacgtctacatgcatacttctcttacactgctgctactggaaaagctgaaccccgcgccaggaccccagccccctgcaaggacccgtgagcgtctgggaagctgtctctgggactgaagccccccacctccgccgggctggcggccactgcggtaccctacgccccgtcgggctggtcctgcacaatttgggaaaaagccgcagcgcttctgcaaggtctacgtggccatgagcatgcaacgcttggctccaaaaaagacacgaaaggagcaaagcgccaacgaccacccgatcggagggcccgaggggcgcctcttcaccagtcagctgcagcttaagttccgtgcattatctgaaaggaacagctggctggaggtatccagggctgtcactccaacctctgcagcagtgacctcaactcccagcacttcaaaacccagacagaaacgtccaacaaactcccagtccaggagcgctgcaaaaccaacgccagttgtttttctgcagaaaatcatcaactgtggagaagaagaagggaaataagaaagaaagaaaaccctaaaaaccaccctggcgcccgggcccgcaggcctcgggccggctctgaaaagtttgggctgtgcacgtgatgagcgcgtaggcgggagccccagacaggacccgggcgggcatttcgagaaaaagcagcggtgacagcctttggtccccatctccattgttcctgccagctctggaccccaggctgcatgagacgtaggtcccaggggacacccgaccccgtggccccagtcttagcttccactgcccctatctggctcatgtcttgctgtctggtgtcatgaactgggagtgcagtaaagaggagtgacaagcctgaggggccacgttcatacctgccactgccaactgtcctgatgtaactgctttgtcatcttgcctgccaggatttgtgacaagggcaagaatcttctgttccatatgcaacatcttctggcagccttgtcctttttctgtccttgacgactacaataacaaacagctgttgccgaggcattgctgttgacgtgttacctttgaaacctccctcctgttatggaataagcctcttccagatcatggctcattatcatctagtctgacaagcagccttgttgccacggagacccaaagggatcaggcgtggcatttgcctgcatcatcaccccctccaggggaactataaggactcttctgtgcgtcatgcgtggctgtcctgggactggctgccaccagacttttcctgcgggtaaaacctaaacaaatgatcagctgcagataatatcaagacctctgtttgatatgttaatagtgacagccagatttccacaattaacaacgaggtgggaagaaaacactgtagtcaccagacttgggaggagagggtttgtattcacataaacacaacctcacgtcactgcttgccaccacaaagggctctgttcactgttttgttctcaaagatcatccttgcgctcatcctctgatcttgaatttctacataactttctcagtttatatgccctgtggcaagtgcagcaagcactgtttcctgtttctaaacttgtagaaaatcatccatacatcttacagttgtcagttttaaccagataacagtggcactttgttgctgcttttttatctttagcttaggttaacaggaccctggaagtaaagttgttgatttattcaatagagtattctcaattaatttggctagatttctacatgattcaaaatctaaaaaagtagaaatgcatgcttacatgtctaaggcctgaaaaattggtagtgacatcccaaaataaatgaaggttttaa

SEQ ID NO: 30606 - DNA, 483 bp, Homo sapiens; identical to SEQ ID NO: 30603

SEQ ID NO: 30607 - DNA, 1642 bp, Homo sapiens
ccccttttgtctttcatctgtttctggttcattggctgggagttgcacctgcgggaggacgtctcatgcagacttgcacatatacagggagtgttgcattgaaggtctttgctggaccttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgcctttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacaggtactgctgggccggaaggtggtggtcgtacgctgcgaaggcatcaacatttctggcaatttctacagaaacaagttgaagtacctcgctttcctccgcaagcggatgaacaccaactcttaccgaggctcctaccacttccgggcccccagccgcatcttctggcggaccgtgcgaggtatgctgccccacaagaccaagcgaggccaggccgctctggaccgcctcaaggtgtttgatggcatcccaccgccctacgacaagaaaaagcggatggtggttcctgttgccctcaaggttgtgcgtctgaagcctacaagaaagtttgcctatctggggcgcctggctcacgagtttggctggaagtaccaggcagggacagccaccctggaggagaagaggaaagagaaagccaagatccactacgggaagaagaaacagctcatgaggctacggaaacaggccgagaagaacgtggagaagaaaattgacaaatacacagaggtcctcaagacccacggcctcctgatctgagcccaataaagactgttaattcctcaaaaaataaaaaataaataaaaataaaaaattaaaaataaagaag

SEQ ID NO: 30608 - DNA, 1542 bp, Homo sapiens
ccccttttgtctttcatctgtttctggttcattggctgggagttgcacctgcgggaggacgtctcatgcagacttgcacatatacagggagtgttgcattgaaggtctttgctggaccttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgcctttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacaggtactgctgggccggaaggtggtggtcgtacgctgcgaaggcatcaacatttctggcaatttctacagaaacaagttgaagtacctcgctttcctccgcaagcggatgaacaccaactcttaccgaggctcctaccacttccgggcccccagccgcatcttctggcggaccgtgcgaggtatgctgccccacaagaccaagcgaggccaggccgctctggaccgcctcaaggttgtgcgtctgaagcctacaagaaagtttgcctatctggggcgcctggctcacgagtttggctggaagtaccaggcagggacagccaccctggaggagaagaggaaagagaaagccaagatccactacgggaagaagaaacagctcatgaggctacggaaacaggccgagaagaacgtggagaagaaaattgacaaatacacagaggtcctcaagacccacggcctcctgatctgagcccaataaagactgttaattcctcaaaaaataaaa

SEQ ID NO: 30609 - DNA, 1547 bp, Homo sapiens
ccccttttgtctttcatctgtttctggttcattggctgggagttgcacctgcgggaggacgtctcatgcagacttgcacatatacagggagtgttgcattgaaggtctttgctggaccttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgcctttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacagttgaagtacctcgctttcctccgcaagcggatgaacaccaactcttaccgaggctcctaccacttccgggcccccagccgcatcttctggcggaccgtgcgaggtatgctgccccacaagaccaagcgaggccaggccgctctggaccgcctcaaggtgtttgatggcatcccaccgccctacgacaagaaaaagcggatggtggttcctgttgccctcaaggttgtgcgtctgaagcctacaagaaagtttgcctatctggggcgcctggctcacgagtttggctggaagtaccaggcagggacagccaccctggaggagaagaggaaagagaaagccaagatccactacgggaagaagaaacagctcatgaggctacggaaacaggccgagaagaacgtggagaagaaaattgacaaatacacagaggtcctcaagacccacggcctcctgatctgagcccaataaagactgttaattcctcaaaaaataaaaaataaataaaaata

SEQ ID NO: 30610 - DNA, 1590 bp, Homo sapiens
ccccttttgtctttcatctgtttctggttcattggctgggagttgcacctgcgggaggacgtctcatgcagacttgcacatatacagggagtgttgcattgaaggtctttgctggaccttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgcctttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacaggtactgctgggccggaaggtggtggtcgtacgctgcgaaggcatcaacatttctggcaatttctacagaaacaagttgaagtacctcgctttcctccgcaagcggatgaacaccaactcttaccgaggctcctaccacttccgggcccccagccgcatcttctggcggaccgtgcgaggtatgctgccccacaagaccaagcgaggccaggccgctctggaccgcctcaaggtgtttgatggcatcccaccgccctacgacaagaaaaagcggatggtggttcctgttgccctcaaggttgtgcgtctgaagcctacaagaaagtttgcctatctggggcgcctggctcacgagtttggctggaagtaccaggcagggacagccaccctggaggagaagaggaaagagaaagccaagatccactacgggaagaagaaacagctcatgaggctacggaaacaggccgagaagaacgtggagaagaaaattgacaaatacacagaggtcctcaagacccacggcctcctgatctgagcccaataaagactctaa

SEQ ID NO: 30611 - DNA, 2876 bp, Homo sapiens; identical to SEQ ID NO: 30602

SEQ ID NO: 30612 - DNA, 569 bp, Homo sapiens
atggtgaagatccggcaatttttgttggctattttgtggcttcagctaagctgtgtaagtgccgccaaaaatgaagtggagcagagtcctcagaacctgactgcccaggaaggagaatttatcacaatcaactgcagttactcggtaggaataagtgccttacactggctgcaacagcatccaggaggaggcattgtttccttgtttatgctgagctcagggaagaagaagcatggaagattaattgccacaataaacatacaggaaaagcacagctccctgcacatcacagcctcccatcccagagactctgccgtctacatctgtgctgtcagacacagtgctccccaggcacctggagcccgtacctaaactctaaagttgaggcatcatttcttactcctgtctttcagacttgtctgtctctatccttggtcagatgatgtaaaatgtttaagtttttaaaatataatattctccccttctagaccatctctcttctctacaacatcatcaccaattatgttaaccagacagtatgtgatttttatcttgaaagtaaaatatac

SEQ ID NO: 30613 - DNA, 2711 bp, Homo sapiens
aattggaatctgaaaattgttattccgttcagtctctgtgcttataagatcaatgtttgtaaaggcctaagctttcttagagattccactgtccaggtgttttcatatatattaagtattttctgtaaacctaaaattgaggttagaaatagaaacccacattattttgtcccttccttgttctttctactgtccctcactttggccctcacaatttcaagtttcccttttcttttgtctgtgcattcattctgtcttgatgtgttgtcttgttttaatccattagttggcatagatggtcttaattgtttttcatccagatatatctaaaaccagaactccttttaaacatacaaaaggttgatttaaaaaattaatggagctgtttaatagtacttactggatatctttgcagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaaggtatgtgaaaaactttgagtagcttgctaatcatggatattatttagtgacatccatgattcactacacccatacattgtggtctttgctctttaaatgtttcctgtggccaggtgcagtggctcacgcctgtaataccagcactttgggacgccgaggtgggcagatcacctgaggtcgggagttcgagactatcctggccaacatggtgaaatcctgtccctactaaaaatacaaaaattagctgagcgtggtggtgtgtgcctgtaatcccagctacttgggaggctgaggcaggagaatcgcttgaacctgggaggcagaggttgtggtgagccgagatgaggtcattgcactccagcctgggcaacaagtgtgaaactccgtctcaaaaaaaaaaaagtttccttaaatagttactggctttatttaaggacttctccatctcccatcacacatcctttataacagactgaagttggcagagaacagaatgatttatttttagggtaaatggaagtttgttctcagcctcttggtttcacttactgtttaaaaccattgttttgcagctatcagttgagggatttgcagttgataaaatggctggagaggttaaggtaaggaaaatactgtttactcttcacttttcagtctagtaagtaaaaacaataacctggttgtaattatagtgttgggataatgtactgtagcatctctgtgtttttgtttagagaaagacatcatgcagggctgtataggccatattaagaatttcctaaaaatggccaggcatggtagctcacatctgtaatctcagcactttgggaggccgaggtgggtggatcacctgaggtcaggacttcaagaccagcccgggcaacatggtgaaaccccaaattagctggacatggtggtgcacgcctctaatcccagctactcgggaggctgaggcaggagaattgcttgagcccgggaggtggaggttgcagtgagctgagatcgtgccattgcactccagcctgggtgacagagcgagactcctgtctcaaaaaaaaaaaaaaaaaaaaaagtcctaaaaatggaaagccttcgaatggtttataaacaaggcagtgccttgatctgatttgtgttataaaaatttcagtctggctgcaatgtggataatagtttggaatggggaagagaagatgttgggaagctaactctcctagcaagaatgatagaatagcttacagtagggtagtggcagtagtggaggagatggaataatggagattcaggggcttgaatttgttaaccatttagttcaacaatatttattgattggcttctctgttgtgagcatatctgggagaggaagaaaaacaagccaggataatccccaggtttctggtgtataaatgttggtactactctgcgatggaatggaaaaagacttgaggccctgagaactgaaccatgattaggagcc

SEQ ID NO: 30614 - DNA, 348 bp, Homo sapiens
atggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagaggtaa

SEQ ID NO: 30615 - DNA, 1069 bp, Homo sapiens; identical to SEQ ID NO: 30604

SEQ ID NO: 30616 - DNA, 1950 bp, Homo sapiens
tttctgagaggccaggtggcaggatgtgggacgactccagctgacaaagacagtctaaccgtggggtaggggctggagcaggggccagcgacccacgtctacatgcatacttctcttacactgctgctactggaaaagctgaaccccgcgccaggaccccagccccctgcaaggacccgtgagcgtctgggaagctgtctctgggactgaagccccccacctccgccgggctggcggccactgcggtaccctacgccccgtcgggctggtcctgcacaatttgggaaaaagccgcagcgcttctgcaaggtctacgtggccatgagcatgcaacgcttggctccaaaaaagacacgaaaggagcaaagcgccaacgaccacccgatcggagggcccgaggggcgcctcttcaccagtcagctgcagcttaagttccgtgcattatctgaaaggaacagctggctggaggtatccagggctgtcactccaacctctgcagcagtgacctcaactcccagcacttcaaaacccagacagaaacgtccaacaaactcccagtccaggagcgctgcaaaaccaacgccagttgtttttctgcagaaaatcatcaactgtggagaagaagaagggaaataagaaagaaagaaaaccctaaaaaccaccctggcgcccgggcccgcaggcctcgggccggctctgaaaagtttgggctgtgcacgtgatgagcgcgtaggcgggagccccagacaggacccgggcgggcatttcgagaaaaagcagcggtgacagcctttggtccccatctccattgttcctgccagctctggaccccaggctgcatgagacgtaggtcccaggggacacccgaccccgtggccccagtcttagcttccactgcccctatctggctcatgtcttgctgtctggtgtcatgaactgggagtgcagtaaagaggagtgacaagcctgaggggccacgttcatacctgccactgccaactgtcctgatgtaactgctttgtcatcttgcctgccaggatttgtgacaagggcaagaatcttctgttccatatgcaacatcttctggcagccttgtcctttttctgtccttgacgactacaataacaaacagctgttgccgaggcattgctgttgacgtgttacctttgaaacctccctcctgttatggaataagcctcttccagatcatggatcattatcatctagtctgacaagcagccttgttgccacggagacccaaagggatcaggcgtggcatttgcctgcatcatcaccccctccaggggaactataaggactcttctgtgcgtcatgcgtggctgtcctgggactggctgccaccagacttttcctgcgggtaaaacctaaacaaatgatcagctgcagataatatcaagacctctgtttgatatgttaatagtgacagccagatttccacaattaacaacgaggtgggaagaaaacactgtagtcaccagacttgggaggagagggtttgtattcacataaacacaacctcacgtcactgcttgccaccacaaagggctctgttcactgttttgttctcaaagatcatccttgcgctcatcctctgatcttgaatttctacataactttctcagtttatatgccctgtggcaagtgcagcaagcactgtttcctgtttctaaacttgtagaaaatcatccatacatcttacagttgtcagttttaaccagataacagtggcactttgttgctgcttttttatctttagcttaggttaacaggaccctggaagtaaagttgttgatttattcaatagagtattctcaattaatttggctagatttctacatgattcaaaatctaaaaaagtagaaatgcatgcttacatgtctaaggcctgaaaaattggtagtgacatcccaaaataaatgaaggttttaa

SEQ ID NO: 30617 - DNA, 3421 bp, Homo sapiens
gagccatggccagcccttccggcagctccaaagccacaggcaagccccgaggctgggatggccggcccaggagggaggaggacgacgtacctcccgaggagaagaggctgcggctggggctggaagggggaagcgcacagcccgaggactgcgaggacggggaggacgcgccgcggccaggcagggaggagaccggcacccagacaggtggcgacggcagaggaatggagtctttctctgtcacccaggcttgagtgcagtggtgtgatctcggcccactgcaagctctgcttcccgggttcacaccattctcctgcctcagcctcctgagtagctgggactacaggtgtggaggggcaggccatcccttcatctggtgcccaacatggggcccttctctagggtgaaggtaccctaagaacgtgagcattgaggacagccgacgagagattcccgagtacgtccacagtcagccttgagacatttgaagttctacaatgaacccatcagagatgcaagggaaggcacctccgcagagacagagaacccgcaatcgaacatcattgactcgcagggtgaacaaaatggtgatatcagaagaacagatgaagttgccatccaccaagaaagcggggccgccgacctgggcccagctaaagaagctgacacagttagctgaaaaaagcctggaaaacacaagggtaacacaaactccagagaataagctgcttgcagctttaatgattgtatcaacggtggtaagtctccctatgtctgcaggagctgctacagctaactatacttactgggcctatgtgcctttcccacccttaattcgggcagtcacttggatagataatcctattgaagtatatgttaataacagtgcatgggtaccaggacccacagatgaccgtggccctgcccaacctgaagaagaaggaatgatgataaacatttccattgggtatcattatccttctatttgcctgggaaaaacaccaggatgcttaatgcctacaatccaaaattggttggtagaagaacctactgtcagtgccaccagtaaatttacttatcatatgataagtggaatgtcacttgggtcacaaatgaataatttacagaattcttcctatcaaagatcattaaaatttaggcctaaatggaaaccatgccagaaggaaattccagaagaatcaaaagacccagaagtcttagtttgggaagaatgtgtggctgatactgcagtggtactacaaaacaataaattcagaattattatagactgggcccctcgaggccaattatattatgactgtatgggccagacccactcatgttcacaggctccatctgtctggcccactaatctggcctacgatggtgacttaactaaaaggctagaccaggtttatagaaggctagaatcaccctattcatggaaatggggtgaaaaggggattccatcaccccgaccaaagttagttagtcctgttgttggtcctgaacacccagaattatgaaagctcactgtggcctcgtaccacattagaatttggtctggaaatcaagttatgggaacaagaaatcataagccatattatactattaacctaaattccaatctgacaattcctttgcaaagttgtgtaaaacccccttatatgctagttgtaggaaacatagctattaaaccagattcccaaactataagctgtgaaaattgtagattgtttacttgcattgattcaacttttgactgacagcatggtattctgttagtaagggcaagagaaggcgtgtggatccctgtgtccatgggtcgacggtgggaggcttctccatccgtacatatcttaacagaagtagtaaaaggagttctaactagatctaaaagattcatttttactctgattgcagtgattatgggtcttattgcagtcacagctactgctgcggctgctggaattgctttacactcctctgttcaaactgcagaatatgtgaataattggcaaaagaattcctcaaaattgtggaattctcagactcaaatagatcaaaaattggcaaatcaaattaatgatcttagacaaactgttatttggataagagataggctcatgagcttggaatatctttttcagttacagtgtgactggaatacgtcagatttttgtattagacctcgagcctataatgaatctgaacatcactgggacatggttagatgccatctacaaggaagagaagataatcttaccttagatatttctaaattgaaagaacaaatttttgaaacctcaaaagcccagttaaatctggtgccagaaactgaggcaatggtaaaagctgttgacagcctcacaaatcttaaccctatcacttgggttaaaaccattggaaattccactattgcaaattttgtattaattcttgtatgtctgtcctctctattgttagtctacagaggtatatccagcagctccggagagacagcgaccagcgagaatgggccatgatgacgatggcggttttgtcaaaaagaaaagggggaaatgcagggaaaagaaagagagatcagactgtcacagtgtctatgtagaaaaggaagacataagagtctccattttgaaaaagacgtgtactttaaacaattgctttgcttagatattgttaatttgtagccttgccccagccactttgctccagccactttgacccaacttgaaactcacaaaaacatgtgttgtataaaatcaaggtttaagggatctagggctgtgcaggaagtgccttgttaacaaaatgtttacaagcagtatacttggtaaaagtcatcgccattctctagtctcaacaaaccaagggcacaatgtactgtggaaagccagagggacctctgcccttgagagcagggtattgtccaaggtttctccccatgtgatagtctgaaatatggcctcatgggatgagaaagacctgactgtcccccagcccgatacctgtaaagggtctgtgctgaggtggattagtaaaagaggaaagcctcttgcagttgagatggaggaaggccactgtctcctgcttgcccctgggaactgaatgtctcgctgtaaagcccgattgtacatttgttcaactctgagataggagaaaagctgccctgtggcgggaggcaagacaagtttgcagcaatgctgccatgttctttactccactgagatgtttgggtggagagaagcatgaatctggcctacatgcacgtccaggcatagtaccttcccttgaaattaattatgatatagattcttttgctcacatatttcttgttgatcttctccttattatcaccctgctctcctactacatttctttttgctgaaataatgaaaatcataatcaataaaaactgagg

SEQ ID NO: 30618 - DNA, 3818 bp, Homo sapiens
atgtatgaaaaaaataaagtaaagagaagaggatctaccatcaaacccaggacaccagaatttaaagtgggaaagaacaaggagtttattaagcttaataccactcttatgtgggaaagtctcctcacaaaatatctgcatgatgaggataatgccttatctttgggttgccagagcctagcagatggagaactttgcactgaggagaaaataaaaacaagtatggctcaaagagaaatactctccatgtggaggaagaaagtgaagtgggcacctgaatttgtctttgatcccagcaacaggcccattccagtgaaaccaagaaacagaccatcctactccctagcccccagacacactccaagtaaacctcagagctctagaaccatcttcttggatccagacacaaggcttacacaaggggacgctggcactaagtcagcactgtggactcagaaccatgcagatcctcatggacacaggtactccccaatgactccagtcaccaggcccatcacagaggactctagtgccatgctgaccctcatggaccgagattacaggcaagttccctcagacctaggctctagaaccatacaacaaatccaagcttcaggcctgcaccagtggacccaggctctgggcctgtcccgacagacaagcagtattatgagattactaggtgaaatgggaatgggtggactcaacataacttctacctttccccagttagcaagggtcctaccctgcccaggtttctgtggcacctctgtgattccaaatcagcgatcaggtgggcagcggtctgggcagtcacccacagggagtacacttggtgctgcacgttcggactttcagtcttgctcaaagcaaagaatctccaagagcgctgaggctacggattcattcgggtggggcgaggtgttattattgtgggattgtctctgcagagttggcctggagagtgagcggtggagggagtggaacaaggcttcgtcaagagtccccaggagtccaggggcgcccccgagacggtggcgcagaggcggcgacactggcaggcgtccggctgccgccacctcccgggtgtggcgggtctggggcccggggtctccggccagagcagctgtggagccacgtgcaacacgcgcgttgccctcagcccgggcggggaccggacgcatccggagctgcggggaggagccgggcgccgcccccggcggcagtgccagccgcgtgggagggcacggaccggcggaggggcagacgacggaggcggccaagcgggaggaacgggaccgagggatcgaccaaggctggctggctaggggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccagcagcagcaggggcagcggggacacaagccgcgaccgagccgccgccgcagccctggctgccacagctgtgtgggatcccagccgacactgcagaaagctccttttactagcagttaaataaatcgaccaaaaacaaaacaaacaaacaaacccaacaacaacaacaacaacaaaagccaagccaaaagccaaaacaaacaaatccagccaaatcaatcattgagaaacaataatattaataaaatccaaaactaaatcaaaccaatcaaggcaccaagacgcaggggggatatccacagttcgatcaaggtaataatcaaggtcttccgacgtgaacattgcacgccttttgtggatttttagaattccttctttctttctgccatatatctgtctgtttcttttgaattttttcttgtctgtatttcttcttcgtgtttgtagaaagctgatgttgttatacatgtattgtgttttttatgtttcgtcaaggagggatggacgctccttcccccagaaaagacagaaatggaaagctggaagttggcaatgattttcatcagagaagtctacagtgatttgtataggctttatggtagaaagtttgcaatgctctttttgaaagagacctattgaagaggtagaaagttatactctgtttgttgtcctggaaggattggggtcctaggtcccaaagggctcaaggggaagaatagaaaagatgttcagttttatttttacatgcatgaaatctgtgcttcattgcaatcgccaatttactcttttctgtctcaggttgtagatatggtggtagaattgagttgaattaggcaggtgtttagaaagtttcttaggaataggaattaactcattcaatgtttatgcatagaaatatagctgaggtggatgtggttgctgtcagctattcaggtttgctacctgatcacctcctgaagatgtagggtaaggacagaatccaagcctaaaagaaaaaacaaggagagaattgaaagttataggggtgggcagttatatttcttaaaaggctggtagaaatcattttcctaagaatgtgtttagagtacagatattcattttaatctttgatttctttaagttttttgatgtttgattttctaccagtatgacactcagcctctcaaaacaagaaggacattccccaaagttgaaatgaatctgtataagatttcattcaaatgcagaataaattcaaatgattcctaacccctcctcatctactttggagataaaaactgctatgattgttttaagtaaacagagaagtggagatgacaggaaatcatttttcatttgttaaaaatcagaaaacctttgacacacttttagataaatacacctactcctttgatcctttgtgtatgtattaccacagggcttaaatatcttaataagattttagttaatgtcattttcatgaaagacagtcatttggaagccaagagctctatctatgttttgttcaaatagccgagtaatctactatcttggcagtaattacttctgctgcatttctaatgtgaattgcatgtgagagcttatgaatacactcttttcaagtgtatgtgggttttcaaggtatgtatttgtgtttgatcctatatttcctttgttataacattctgcttttcatcactttgacagaatatttgtaaattttctggagagtgagtttgggtatatgctttgaggaatatgcttcctcattacaaaagatatggaaacataattgattactacacttgcttatcaatagtattttgattttgtttaaatgaaatgtttaagatacgtggattgctatgcattcatgttttagatttatcctctccaggcatgatttatgccattcaataattaaaataactaagttactttagaaaaagtgcctattaaacagagtactttgtttagaggacgtatatttaaataaacttatacagctaaaga

SEQ ID NO: 30619 - DNA, 1875 bp, Homo sapiens
agaggcaagaaaggaacagtctgaggtttgagtctgacccaggacctctttgtggtcaaaaagtgaggggggaggaaacaggatgaaaggcttgagagtggcaaaagcttttcagcccagccaagggtgctccaggcaagcgctggggcacctctctgggagaggaccttcaccaaggtcagagatgaacagcagtgttggggacctgggtgttggcggctgcagcctctgggatgaccctgctcgcttcatcgtggtgcccgcggcctatgccttggcactgggcctggggctgccagccaacgtggcggccctggcaatgttcatccgcagcggcgggcgcctgggccaggccctgcttctctacctgttcaacctggctctggttgatgagttcttcacgctcacgctgcagctgtggctcacctactacctgggcctggcccggaggccgcctgccacgcggccggggccacctactacgtgtccacctatgcggcggtggtcttcgccgcgctcatcagcgtgtgccgctgcggcttcgtacgcggtcccgggcccagggcggctgcccgcctggcccggtgcctacggcgccccgcgcgcgctgcctgcgccttcgcctggctggcgggcctggcccctccctgcctggagcaccgctgggcaagctcggggctggcctccgccacggtggccttcgcggccgccttcctgctggtgctcgcggccaacgtgagcctggcgcgggcgctcaaggcgccctctggcccgggcccgggccctgcaaccgccggcgcgcaccggcgcgcggccaagaccatggtcctggggttcctgctggtcttcgccctcagtctggcgcccaaccacctgctgctggcgccctaggtggctgggggggaagacaacggagaccggtgtcgcgccgcctccacgctcgacatcctgcacaccctcagcctggcgctgctgagcctcaacagctgcctggacccactcatctgctgcttcttcgtgcgcctcttccaccaggactgctgctgggcactgagctgccgcctggtgaagggggcgcccagggcgcatggggcctccttggcctcctcttggagagtctcctggcctcccctcctgtctcacccccctgtcaccctcccagtggcatccagggtggagaaagctctttggaaagacctagattctaatcctgacgcaaccacatactacccctgtagctgtgaacctccgggctcatctgtaccaaggacatagaacattctttgtaacccgaatgttccctggatgttgccagcttttggatacaaataatataccactgtgttttttttaaacctcttgggataaaacccaaagtccttatcatggcctacaaggccctgtctgatttggctcccctttctctccctaacccaccacccctgcgtctccctgcaggcagtcaccttcttaggcccgggaaaatgccggtctcctactcttcatggcctttgtacctgacttggccaggaatgatctctgttcctctctttcactaagttagttcttcttcaccctcacttcctctaaagtaactccttatagggaagcctttcttggctggcaacacacacacacacacacacacacacatacacacacgactgaatcagatcggattgctctttgatagctcttttcataattgtaatcaagcaattaattgggtaatgcgttgttgttgttttctttctctcttgccagaatgtattcatgttgacccataagacattatcatttttataagtccccaaaagttgaatattggaaattttatttccacccaattcaacttaataaattctgtgtttacct

SEQ ID NO: 30620 - DNA, 1875 bp, Homo sapiens; identical to SEQ ID NO: 30619

SEQ ID NO: 30621 - DNA, 3113 bp, Homo sapiens
tcacttaataatatatctactcagagcaagtggctgaaatatcaaaacacatcccaatgcaacgtggctactccaaacagagttgataagagaataactgatggcttctttgctgaggctgtttctgggatgcattttagagacacaagtgaaagacagagtgatgctgtcaatgaaagctctttagactctgtgcatttgcaaatgataaaaggcatgctctatcaacagcggcaggattttagcagtcaagattcggtttccagaaagaaagtactttctctgaatttaaagcagacttctaagacagaggaaattaaaaatgtattaggagggtctacctgctacaactacagtgtaaaggatttacaggagataagtggctctgagctgtgctttccaagtgggcagaaaataaaatctgcttatcttccccaaaggcaaattcacataccagctgtttttcagtctcctgctcattataagcagactttcacatcttgcctcatagaacatctaaatatattgctgtttgggttagcacaaaacctgcagaaagctctttcaaaagttgacatatcattttatacatcattgaagggagagaaactgaaaaacgcagaaaataatgtaccatcctgccatcatagtcaacctgcaaaacttgtcatggttaaaaaggaaggtccaaataagggtcgtctcttttatacatgtgatggacccaaagctgatcgatgtaaattctttaaatggcttgaggacgtgactccaggatattcaacacaggaaggagctcgacctggcatggttttaagtgatattaagagtattggcttatatttaagaagtcaaaagataccactttatgaggaatgccagcttttggtgagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaaatgatctttgggtggtttcaaaaaccctagactttgagctggatacttttatcgcatgtagtgctttctttggaccatcatctatcaatgagatagaaatactgcctttgaaaggctatttcccttctaattggcccactaacatggttgtccatgcgttattggtttgtaatgctagcacagaactgactactttgaaaaacattcaggactactttaatccagctactctacctctaacacagtacctgttaacaacgtcttcgccaactatagttagtaacaaaagagtcagtaagagaaaatttatcccaccagccttcacaaatgtcagtacaaaatttgaactactcagcctaggagcaacattgaagttagctagtgagttgattcaggtacacaagttaaacaaggatcaagctacagctctaattcaaatagctcaaatgatggcatcacatgaaagcattgaagaagtgaaggaactgcaaactcataccttccctatcacaatcatacatggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggcttctcagtcttggatttgaaaactttatcagagttgggagtgttaggaagattgccaaaccaattttaccttatagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggttcgagtagttggagttacctgtgcagcctgcccattcccatgcatgaatgatcttaaatttcctgtagttgtgctggatgagtgtagtcagataactgaaccggcctctctccttcccattgcaaggtttgagtgtgaaaagctgattcttgttggggatcccaaacagctacctcctactattcagggttctgatgcagctcatgaaaatggattggaacaaactctttttgatcgactttgcttaatgggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacagatagaaagagataacagctttcataatgtggcagaagctacgtttacactcaagctgattcaatcactgattgcaagtggaatagcaggctctatgattggtgtgataacattatacaaatcccagatgtacaagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttct

SEQ ID NO: 30622 - DNA, 2743 bp, Homo sapiens
attcttctactccatttgaagatgaaaaataaaggccaaaatcataggcctggcacagaagctggataatgaagacagctccggaggaacacatagatacacacacatatagacacacacatatataaagtacacagacatattatttttaaagtttattttttaaagttttaaagtttctaaaatgaaagctggccctgcctctctcccagagtgagcggagacagcggttgcatgagcagctttccttgtgaggccacaggtccctctggacacgctgctgcctgaccatgcctcctttccctttcagctttctcatagaccaatgggcttggagcattaaggccatacccctattatgcattctagtgcgaccttgtttacacctcccctggctcagtcacacagctgtgtggtaggctactagaagtgtttagtagttgtcactgggatcatgctgatgtggccccatccccgcctctccctgccctgtgatatcggaggaaacctgacagagcaaattggccatggccaagaaaaaggaaaagaaagagtgccaccaaaagcagggagccctaagggagcagttacaggagtctgaggatctggccagccgcctttagtattccaggcagtgtgtgggagagttggagcaggctctctgctgtctccacacagcagaagaaagcagacagggtgacggagctggactccatctcaaaacaaacaaacaaacaacaacaaaaaaaaaaacaaatgagaccatgggcttggaaatgccttgaaaaaatgtcaagtgtgattcagagtgaggaagtattactgtggaatagttactgtagctattgttaccggtcggccaactgctcctctgcctgctatatcctgacttaaccttggtctgtatttgccgtacaacaaggagttaaccaaagagagagacgccctcaggctggagttatacaagaacagttcattcctttctctactgcttctggccataaccgaagcaatgaggacctgaagcaggagaaatcagaattggaagagaagcttcaagtcctggtgactgagaaggctggcatgcagcttattttagaagagccgcaaaagaaattacaaatgatggcactcctgcttcaacaggctaggggttttcaaggcactgtgaagcccctgatgcgaaacagcagttaccgcaggccatggaggagcgggcacagctgaaagcacatctagggcaggtaatggagtcagttagataactacaaacggagagagatacgtatgctgaaaatctgaaaggagggagggccatgtggtgtcagaggaagcaacagatgtcggagcagcagggccctccaaggtggagcagcagctacaagcagaggctgaccacctgcagaaggagctggagagtctggcagctccgagcccaggagcaagacactgagggcttcagtcacccgaaccaggagtaggaggagaggctgctggagctggagcaggtggccgagctcttgcgggagcaggcagagtcacgcaggcaaatcctggagaccatgcagaacaaatgcaccaccatcagccacgtgctcacccagaaccacaagctcaaagagcagctgtctccgctgcagaacggattcataaagctggtgccacgggaggcagacaccaagttctggggtctccagctgcagtgggtggccgccaattgcttctctctgtccagactaatgagaacatggagatcaccagtgcactgcagttggaatagcacgtaaagagggagctgggaaagaagctgggcaagctaaaggacatggtaaccctgccccatccaagaagagctggaaggcgggcaccagcctctggggaggggaggtgtgaagccagaggcagctccagcctgggggacaggtgaccccagcaccctccagggcagtcctgtgactgtttcttgcttcccgccctctgacatttagtggtgggttcgttcttcctaggtctggacatcatcatcccagctggagtcatggagcctcccaaacatagggaaagagatggtggtataagaggttccttagagtcaaactagattccggccttggctccactggtcacctacttttcatctctaagtctcggtttctttaacttaaaagggaagttagcaccttcctcttggaggtgctgaggattaaatgagataatacgtggaaagcattaggcatgtagcacagttagcagatggtggttggctccctctgcttttccatcagtctgtggcctagtttaaatggtgggaggaagggtgtgagatttaaggctggttgtaagggatcagtcagtgtagttggaaaaattgtaagatgaagttataggatatagacacaaaccttcctggaaggccagaaagtctgcatagcttcaataaaggatttggctgaaagcagcgtaatcccctttaccttgagttgatagcaatagagcaaataacatgggaacgtgggggagtttattgaatagcttgtttactcatgtggtcctaagaccaacctttgattatccacgggtgcatgattgctctctactcggtggtcggcaaatttaattacccacaggtgtgttgactcaaagcctctgtcattaaatctatgctgaataaatgccgtcagggccagctagtcaaggtgcacaactctttttgtgcgtggtgtggccccttagctgctctgtc

SEQ ID NO: 30623 - DNA, 2743 bp, Homo sapiens
attcttctactccatttgaagatgaaaaataaaggccaaaatcataggcctggcacagaagctggataatgaagacagctccggaggaacacatagatacacacacatatagacacacacatatataaagtacacagacatattatttttaaagtttattttttaaagttttaaagtttctaaaatgaaagctggccctgcctctctcccagagtgagcagagacagcggttgcatgagcagctttccttgtgaggccacaggtccctctggacacgctgctgcctgaccatgcctcctttccctttcagctttctcatagaccaatgggcttggagcattaaggccatacccctattatgcattctagtgcgaccttgtttacacctcccctggctcagtcacacagctgtgtggtaggctactagaagtgtttagtagttgtcactgggatcatgctgatgtggccccatccccgcctctccctgccctgtgatatcggaggaaacctgacagagcaaattggccatggccaagaaaaaggaaaagaaagagtgccaccaaaagcagggagccctaagggagcagttacaggagtctgaggatctggccagccgcctttagtattccaggcagtgtgtgggagagttggagcaggctctctgctgtctccacacagcagaagaaagcagacagggtgacggagctggactccatctcaaaacaaacaaacaaacaacaacaaaaaaaaaaacaaatgagaccatgggcttggaaatgccttgaaaaaatgtcaagtgtgattcagagtgaggaagtattactgtggaatagttactgtagctattgttaccggtcggccaactgctcctctgcctgctatatcctgacttaaccttggtctgtatttgccgtacaacaaggagttaaccaaagagagagacgccctcaggctggagttatacaagaacagttcattcctttctctactgcttctggccataaccgaagcaatgaggacctgaagcaggagaaatcagaattggaagagaagcttcaagtcctggtgactgagaaggctggcatgcagcttattttagaagagccgcaaaagaaattacaaatgatggcactcctgcttcaacaggctaggggttttcaaggcactgtgaagcccctgatgcgaaacagcagttaccgcaggccatggaggagcgggcacagctgaaagcacatctagggcaggtaatggagtcagttagataactacaaacggagagagatacgtatgctgaaaatctgaaaggagggagggccatgtggtgtcagaggaagcaacagatgtcggagcagcagggccctccaaggtggagcagcagctacaagcagaggctgaccacctgcagaaggagctggagagtctggcagctccgagcccaggagcaagacactgagggcttcagtcacccgaaccaggagtaggaggagaggctgctggagctggagcaggtggccgagctcttgcgggagcaggcagagtcacgcaggcaaatcctggagaccatgcagaacaaatgcaccaccatcagccacgtgctcacccagaaccacaagctcaaagagcagctgtctccgctgcagaacggattcataaagctggtgccacgggaggcagacaccaagttctggggtctccagctgcagtgggtggccgccaattgcttctctctgtccagactaatgagaacatggagatcaccagtgcactgcagttggaatagcacgtaaagagggagctgggaaagaagctgggcaagctaaaggacatggtaaccctgccccatccaagaagagctggaaggcgggcaccagcctctggggaggggaggtgtgaagccagaggcagctccagcctgggggacaggtgaccccagcaccctccagggcagtcctgtgactgtttcttgcttcccgccctctgacatttagtggtgggttcgttcttcctaggtctggacatcatcatcccagctggagtcatggagcctcccaaacatagggaaagagatggtggtataagaggttccttagagtcaaactagattccggccttggctccactggtcacctacttttcatctctaagtctcggtttctttaacttaaaagggaagttagcaccttcctcttggaggtgctgaggattaaatgagataatacgtggaaagcattaggcatgtagcacagttagcagatggtggttggctccctctgcttttccatcagtctgtggcctagtttaaatggtgggaggaagggtgtgagatttaaggctggttgtaagggatcagtcagtgtagttggaaaaattgtaagatgaagttataggatatagacacaaaccttcctggaaggccagaaagtctgcatagcttcaataaaggatttggctgaaagcagcgtaatcccctttaccttgagttgatagcaatagagcaaataacatgggaacgtgggggagtttattgaatagcttgtttactcatgtggtcctaagaccaacctttgattatccacgggtgcatgattgctctctactcggtggtcggcaaatttaattacccacaggtgtgttgactcaaagcctctgtcattaaatctatgctgaataaatgccgtcagggccagctagtcaaggtgcacaactctttttgtgcgtggtgtggccccttagctgctctgtc

SEQ ID NO: 30624 - DNA, 5723 bp, Homo sapiens
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtaaaaaaaaaaaaaaaaaa

SEQ ID NO: 30625 - DNA, 2082 bp, Homo sapiens
gaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtcactttttaatggctatctaacactccatatgtggtgggcaagtctggttggcctccggggggtttccaggtataggggatgtagggccttgcctggcctggtctgcgggtccatcgtcagtgcctgagcggccagcagaaggggggcagcagcctccactgagcctctggttcccatttcccaggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgc

SEQ ID NO: 30626 - DNA, 1452 bp, Homo sapiens
gaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttaa

SEQ ID NO: 30627 - DNA, 6928 bp, Homo sapiens
ggcgggagcgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaacataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtggttatggagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcagtgatcctcccgcctcggcctcccaaagtgctgggattacaggcatgagccaccgcgcctggcctctgcttactttttatatagcaaaatgattccccttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacggctgtatataatggtgatgtcataataaagttgttttatcttttaagtaaaaaaaaaaaaaaaaaaaaa

SEQ ID NO: 30628 - DNA, 2400 bp, Homo sapiens
gagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcaccgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacgtgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtatggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttaaaaaaaaaaaaaaaaaaaaaaaaaaaaaaaaaaaaaaaaa

SEQ ID NO: 30629 - DNA, 4144 bp, Homo sapiens
ggggcgaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaaaaaaaaaaaaaaaaaaaaaa

SEQ ID NO: 30630 - DNA, 1908 bp, Homo sapiens
ctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccatttctaaaaaataaagacattttcagatctga

SEQ ID NO: 30631 - DNA, 534 bp, Homo sapiens
ctggcgcaaacgcagcgggtggctggggtaggggctcattgggagcccacggagcgcggcggcggctcgggggccgagttccctacaacaaggatggcggtgacgggcgcagggagcggggcccggctctccttgcctcgaggctcctctgattccactcgcgtggctgcgcggccctggcagcggccttcgtcccgggggtgggagctacacagggttccgccccgtcctggcgaggacgcctgagggggctctgtggtaaggctctgtcgggcaggccgggcttccgggaggacctggtctggatcggtcaccgctgggtgcctgagctccgcatggagcctgcagcctttgtttaacttataaagaaatgggggctccgagcagtcaagaagaacatgccccaagttattcgtcagtgaggcggaaattgtggtgtacttgttccagaccaactatgaagataggatgcccatccagaagaacgggaagcattttcttcctcacctttggaaagtaaaacaaaaaaaaaaa

SEQ ID NO: 30632 - DNA, 534 bp, Homo sapiens; identical to SEQ ID NO: 30631

SEQ ID NO: 30633 - DNA, 1276 bp, Homo sapiens
ggaagtctgtcaactgggagggggagaggggggtgatgggccaggaatggggtccccgggcatggtgctgggcctcctggtgcagatctgggccctgcaagaagcctcaagcctgagcgtgcagcaggggcccaacttgctgcaggtgaggcagggcagtcaggcgaccctggtctgccaggtggaccaggccacagcctgggaacggctccgtgttaagtggacaaaggatggggccatcctgtgtcaaccgtacatcaccaacggcagcctcagcctgggggtctgcgggccccagggacggctctcctggcaggcacccagccatctcaccctgcagctggaccctgtgagcctcaaccacagcggggcgtacgtgtgctgggcggccgtagagattcctgagttggaggaggctgagggcaacataacaaggctctttgtggacccagatgaccccacacagaacagaaaccggatcgcaagcttcccaggattcctcttcgtgctgctgggggtgggaagcatgggtgtggctgcgatcgtgtggggtgcctggttctggggccgccgcagctgccagcaaagggactcaggtaacagcccaggaaatgcattctacagcaacgtcctataccggccccgggggcccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtgagagatcccaggagacctcaacaggaccccacccataggtacacacaaaaaaggggggatcgaggccagacacggtggctcacgcctgtaatcccagcagtttgggaagccgaggcgggtggaacacttgaggtcaggggtttgagaccagcctggcttgaacctgggaggcggaggttgcagtgagccgagattgcgccactgcactccagcctgggcgacagagtgagactccgtctcaaaaaaaacaaaaagcaggaggattgggagcctgtcagccccatcctgagaccccgtcctcatttctgtaatgatggatctcgctcccactttcccccaagaacctaataaaggcttgtgaagaaaaaaaaaaaaaaaaaaa

SEQ ID NO: 30634 - DNA, 941 bp, Homo sapiens
agtcggcgccaaaatcaaacgcgtcctggcctgtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacaataaaaatccatccatctc

SEQ ID NO: 30635 - DNA, 1728 bp, Homo sapiens
acggggacactggcccgactactttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagtttcttgaagacgagtacccagacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttgcagttattggagccctgttacagagcagtggacctgagaggactgcacttttcatcagggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactgtgataaaaagttgattgcagaaggacctggggaaacagtattggttgcagaagaagaggctgctcgagtggcccttagaaaactttatggattcacagaaaatagacggccgtggaactattccaagcccaaagaaaccttgagagcagaaaagagcatcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataaatgttaaccaagtcacagtgtttttggttttgtttttctgaaatcttggtttgatcaaatctttttttttttctcttgagatggagtcttactctgtcgcccaggctggactgcagtggtgcgatctcggctcactgcaacctccacctcacaggttcaagcgattctcgtggctcagcctccctagtagctgggattacaggcacacaccaccatacctggctaatttttgtatttttggtagagatggggtttcaccaagttggctagactagtcttgaactcctgacctcaggtgatccacccgccttggcctcccaaagtgctgggattacaggtgtgagccactatacccgaccagatcaaatctttttttgacatttttgcaaaaaaattttcctaatgttcttgatttaattgtatagaatttgtataattaggtgtattttatttgcctctagctttgaggtatcataatttatgtatcttatgtgaattttttgctgtaataccaataaagttttttttctccac

SEQ ID NO: 30636 - DNA, 1872 bp, Homo sapiens
ctagcctggcgctgggggcgggcaccagcccccacccctcggcgtcccctccccttcacttcccccaccccctgtcccctcccttccctcccttcccccccgtggcgaggcagcagcgacggcggcggcggcagcggcggtcgcggctgaggctgaggaggaggcggcggcggcgggcggggctcggctcgggctccgcgggcgggcgggcggacatggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtacaaaaaaaaaaaaaaaa

SEQ ID NO: 30637 - DNA, 3342 bp, Homo sapiens
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctaaaaaaaaaaaaaaaaaaaaaaaaaaaaa

SEQ ID NO: 30638 - DNA, 758 bp, Homo sapiens
gtcatcgggacgtactaagactagggttgggccgagagtcggagccattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggccctcggtaaaa

SEQ ID NO: 30639 - DNA, 713 bp, Homo sapiens
gtcatcgggacgtactaagactagggttgggccgagagtcggagccattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggccctcggtaaaa

SEQ ID NO: 30640 - DNA, 1038 bp, Homo sapiens
aggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggcctccgaggagctgctgcgtgagcactacgccgagctgcgtgaacgcccgttctacggccgccttgtcaagtatatggcctccgggccggtggtggccatggtatggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcggtttgggcccaggaacaggcaaaaaaaaaaaaaaaaaaaaaaaaa

SEQ ID NO: 30641 - DNA, 1586 bp, Homo sapiens
gaggacaggtttgtgcgctggacgcaagcaccaggcgcagcctcgctcgccgacacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcccttttctctgctcaataaatattttaaaagca

SEQ ID NO: 30642 - DNA, 972 bp, Homo sapiens
atgggcatggagggtcttctccagaactccactaacttcgtcctcacaggcctcatcacccatcctgccttccccgggcttctctttgcagtagtcttctccatctttgtggtggctataacagccaacttggtcatgattctgctcatccacatggactcccgcctccacacacccatgtacttcttgctcagccagctctccatcatggataccatctacatctgtatcactgtccccaagatgctccaggacctcctgtccaaggacaagaccatttccttcctgggctgtgcagttcaaatcttctacctgaccctgattggaggggaattcttcctgctgggtctcatggcctatgaccgctatgtggctgtgtgcaaccctctacggtaccctctcctcatgaaccgcagggtttgcttattcatggtggtcggctcctgggttggtggttccttggatgggttcatgctgactcctgtcactatgagtttccccttctgtagatcccgagagatcaatcactttttctgtgagatcccagccgtgctgaagttgtcttgcacagacacgtcactctatgagaccctgatgtatgcctgctgcgtgctgatgctgcttatccctctatctgtcatctctgtgtcctacacgcacatcctcctgactgtccacaggatgaactctgctgagggccggcgcaaagcctttgctacgtgttcctcccacattatggtggtgagcgttttctacggggcagccttctacaccaacgtgctgccccactcctaccacactccagagaaagataaagtggtgtctgccttctacaccatcctcacccccatgctcaacccactcatctacagcttgaggaataaagatgtggctgcagctctgaggaaagtactagggagatgtggttcctcccagagcatcagggtggcgactgtgatcaggaagggctag

SEQ ID NO: 30643 - DNA, 4467 bp, Homo sapiens
gcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcggggaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggaaataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtggtaagtgcctgtagtcctagctacttgggaggctgagatgggaggatgtcttgagcccgggaggtggaggttgcaatgagccaagattgtaccactgcattccaacctgggcgacagagccagaccttgtctcaaaaaaaaaaaaaaaaaaagaaaaaagaaagtactgtctgtcttaaattttgctgcaaataaaaatgtactttggattatttattgttgaacttgagagatagaaataacatcagatatattttttcttttttttttataattaattttttttttttttttttttgtagagacagtgtctcactatgttgcccaagctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataa

SEQ ID NO: 30644 - DNA, 2960 bp, Homo sapiens
tccgggaggattacccaggagaccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacaccagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatcgaaataccaactatgtgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaa

SEQ ID NO: 30645 - DNA, 2876 bp, Homo sapiens
tccgggaggattacccaggagaccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccaggaatttttctttaaatgtggagcacaccccacctctgacaaggaaacaccagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatcgaaataccaactatgtgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaa

SEQ ID NO: 30646 - DNA, 2513 bp, Homo sapiens
tccgggaggattacccaggagaccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcaggaatttttctttaaatgtggagcacaccccacctctgacaaggaaacaccagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatcgaaataccaactatgtgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaa

SEQ ID NO: 30647 - DNA, 2622 bp, Homo sapiens
tctcccctcccgccgcccgggcgagcgacacggctgcggcccccctcccctcccttccctccctccctcccatccccccctccccgagacccaccggaccccgaacccagatggccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaatcgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctctttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttctaaaaaaaaaaaaaaaaaa

SEQ ID NO: 30648 - DNA, 5355 bp, Homo sapiens
gaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaactatagcttcagaagcatttttacttgcaagacgatggacacattccccttgggctttttgtaactgaaacgcaccacagaagacagggagtcatcgaagggctgctcggggaggtggcagggcggaggacctgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagcactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagacaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataacaaaaaaaaa

SEQ ID NO: 30649 - DNA, 1384 bp, Homo sapiens
accgttcttttaactgcgcaggcgcgccggaagcacctagagagcggcgcgtgcgcagcgggagtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggccctgcagaaggatctcagcctctctgaagatgtgatggtttgcttcgggaacatgtttatcaagatgcctcaccctgagacaaaggaaatgattgaaaaagatcaagatcatctggataaagaaatagaaaaactgcggaagcaacttaaagtgaaggtcaaccgcctttttgaggcccaaggcaaaccggagctgaagggttttaacttgaaccccctcaaccaggatgagcttaaagctctcaaggtcatcttgaaaggatgagactcaagaaccaagatgggggaccagcaaccccccagggtcatggaggacccaggaccctccaaccttgacacctgtaaggacaggatctgccctgtaaggggccagccgtcaggaatctggccatgaaaacctctttgtagtgcttggctactctgtgatggcaggagggaaccttcagcctgtctggctgctggacctggacaccagggctcggtggacacaagatctattgacgggccttggtagccaccagtgggtgtgtggggcagtggctgtgggggtgtaagaatgactgcaacaggcacttcccaacaatggcctgctgttcacatggaccctgagcaaggaaggagggagggaggggcagagtggagtgtcattccagcattcctctcagaagggagagaggttttcaggctggtgccatgcgattggaataaagcaggaggctcatgggtggttgctgaatgaagaacagaatcttggtgctttgtggctcaccacagccatctgtggggcaggcacacacacctcccgccagctccaattttgcactttttccctgcttgattccaagagtaggtgctgcctagcagcccttcgtggccactctttactcaggagggccttgcagagtcctgcaccaggcctgggtgagtggatgcgcctcttaccatatgacacgtgtcaagatgcccttccgccccctctgaaagtggggcccggccagcactgctcgttactgtctgccttcagtggtctgaggtcccagtatgaactgccgtgaagtcaaaactcttatgtgttcattaagggctcaataaatgttagctgaatgaatgaatagcaaaaaaaaaaaa

SEQ ID NO: 30650 - DNA, 1451 bp, Homo sapiens
tctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggaggtgtatagtgttgattggagccaaaccagaggtgaacagcttgtggtgtctggctcatgggatcaaactgtcaaattgtgggatccaactgttggaaagtctctgtgcacctttagaggccatgaaagtattatttatagcacaatctggtctccccacatccctggttgttttgcttcagcctcaggtgatcagactctgagaatatgggatgtgaaggcagcaggagtaagaatcgtgattcctgcacatcaggcagaaatcttgagttgtgactggtgtaaatacaatgagaatttgctggtgaccggggcggttgactgtagtttgagaggctgggacttaaggaatgtacgacaaccagtgtttgaacttcttggtcatacctatgctattaggagggtgaaattttcaccatttcatgcttctgtgctggcctcttgctcgtatgattttactgtaagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtagtctctgggtcataaaatggattaaaatatgggagatcagtaggttatacgtatatagatagtgatatatttcatttttaatttgtcatttttgatgtaaaatataatcactgctgtgataaataaactatctattgatc

SEQ ID NO: 30651 - DNA, 3192 bp, Homo sapiens
cacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttggttaagcaatatttttaagggccaaaatgattcaaaacatcacaggtatttatgtgttttacaaagacctacattcctcattggtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatcaaatgttgtgttcatgtttggggaaaatataatttgcagaaacctatgaagtagagcaaagatgctttaaaaagataagtttttttgaactaaattttttttagttctaataatgcacataggatattagtacatcgtacacgtgctaggaaaaaacagcttcagtgtctttgtttaatgtgttgaaactcatctttttaaatcttgaaaaaccaattgtttacttgaaacttgaaagtagcatatttttctgttttttggttgtttgttcatttgtattagcacaatttaatgtaattcctggtttggaggcagcaagacctatgagcaagaactatttacttgaccctcgtttttttctcttgttcttgtgtggtctgaaatctaaaactagactttattatgatagatttcctataagccaatttctaataacaaatagatttattatttaatctgtaccttctatcttctcataattcgtggtcttacagccttccaaaataactccagttgggcacccatgagctaggatcaaactttctttatatactttatatattttacattatttctgatttttaaagcaaatgattgtgattacactcaacctaaatagttatgaacagtttcagaacaatgaaaaattacaatactatgtgatagtattgtaactatttttctattttagtcatatgtcgcttatatcctaccagaactcttaaatctataatattcgatatattctacaaactgctttattgtagaagccatatttatgtttattttataatgttttctagtgtcaaactgtactgtggagaaaagaaatgttagatctgtaaaaaaaaaaaaaaaaaa

SEQ ID NO: 30652 - DNA, 4284 bp, Homo sapiens
ggccaaggcggcgaccggagcgcgatggcgggggcggcgggactcacggcagaagtgagctggaaggtcttggagcgaagagctcggaccaagcgctcaggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggttggcggtgcgctacggggctgcatttacccagaaattttcttcctctatagccccacacattactacttttctggtacatgggaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgccttttaaacccagctactgaggaggctgaggcatgagaattgcttgaaccaggagacggaggttgcagtgagctgaaatcctgccactgcacaccagcctgggtgacagagcgagactcc

SEQ ID NO: 30653 - DNA, 3821 bp, Homo sapiens
ccacgcgtccgaaggcggcgaccggagcgcgatggcgggggcggcgggactcacggcagaagtgagctggaaggtcttggagcgaagagctcggaccaagcgctcagttttaaaattgctatagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgacgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccatgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactaaaaaaaaaaaaaaaaaaaaaa

SEQ ID NO: 30654 - DNA, 1393 bp, Homo sapiens
gaccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatatt

SEQ ID NO: 30655 - DNA, 7237 bp, Homo sapiens
gaggaagaggaagtcggagcccgagcctgagcccgagcccgagcccgacggcggctgcagggcgctccggcagcccgagccggcgcagcgcagcccgcaccctccccgcccgacctgcgagcgccgcccgggcatgcgaagccgtccctccccgggtgaagactgatgagaagagtctgtgggtgaagacattgaaaaggtttcaactataaaaatgggcaccagttgcgtcttgaagtgccatcagctgtaaccaaagttccacatcccaagacgacagccaggcgttcctgccctcaagaactgaagacaatggagctctctgatagtgaccgacccgtcagcttcggttccacatcatcctcggcctcttcccgcgacagccatggttccttcggcagcagaatgaccttagtttcaaatagccacatgggcttgtttaaccaggataaggaggtaggggccataaaactggagctgattcctgccaggccgttttccagcagcgagctgcagagggacaaccccgccacggggcaacagaacgcggatgagggcagcgaaaggccacccagagcgcagtggagagtggactcaaacggggcacccaagacgatcgcagactcggccacgagccccaagctcctctatgtggatagagttgttcaggaaattctggaaaccgaaaggacttatgtacaagatttaaaaagcatcgtagaggattaccttgactgcatcagggaccaaacaaaacttcccctggggaccgaagaaagatcagccctttttggaaacatacaggatatctaccacttcaatagtgaacttctgcaagatttggaaaactgtgaaaatgatcctgtggccatagcagagtgttttgtgtccaagagtgaagagttccacatttatacccagtattgcactaactatccaaggtccgtggctgtgctaacagagtgtatgaggaacaagatactggccaaattcttcagggagcgtcaggaaactctgaaacactcgctgcctctggggtcctatctcttgaaaccagttcagcggattctcaagtatcatctccttctgcatgaaatagaaaaccaccttgataaggacacagaaggctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagagagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagtacaaggt

SEQ ID NO: 30656 - DNA, 3239 bp, Homo sapiens
ctcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattcaaaaaaaaaaaaaaaaaa

SEQ ID NO: 30657 - DNA, 5093 bp, Homo sapiens
gcgcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaactttgcttatttcttttgcagcaataagcatgcataataagtcacagccaaatgcttccatttgtaatcaagttatacataattataaccgagggctggcgttttggaatgcaatttgcacagggattggaacatgatttatagttaaaagcctaatatgcagaaatgaattaagatcattttgttgttcattgtgcagtatgtatatagcataatatacacagtgaattataggtctcaggcttacttgatttttggctattttatatttagtgtacacagggctttgaaatattaatttacataaaggccttcatatattattacgtgttatatattacgtgttataaatttattcaataaatatttgcctagaattcccaagacctttataggtgattttgttttctgggctccttaacttcataaatagctagtatcttccagcagtagtaacagtctggataacttcttccatatccctccctctttgtttttttgagacagtgtcactttgtcacccaggctggagtgcaatggtgtggtctcggctcactgcaacctccacctcccgggttcaagtgattctcccgcctcagcttcctgagtagctggaactacaggcgtgtgccaccacacccggctaatttttcgtatttttagtgtagacggggtttcactatgttgcccaggctggtctcgaactcctgaccgcgtgatccaccacctcagcttcccaaagtggtgggattacaggcgtgagccaccgcacccggcctccatatcccccttttaaaattctgtagtgtatggtaagtcatatcagatatcagacctaatttaaatttcattttagctttacaagtccaaaaacacagaatttatatattcagatactctagcactaattttagtcttaaaatattcccacgatattctgtacacaaaatgttctttttgttacaagagctgagttgcatatactgtagataaatcatattatttttgccaatttcacaaattcctctggcccatcatgtcagtcattattgagtatatgcacacattgctacttatttgattatgtatcttttaaattgattcagtgcatagaaaactatctcttacaaactttaagtgctctgatatgacttcccccccaaattttattatgaacatttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgtatttactttttatgtggccctctctttaggggattctaattttacttagggtctctaagtgcagcataatgttcctgatgttaacagaagactgtatttttaaagttacaaatttgtatatggaattaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggcaatgcaaatgatttttaatctttttttattatcttttcagcagtttatattttttgtgactttatgcaaccatatttttactttgtcttgacaactgaaagatgtataaggttttttgccagaaatgtactgtatacatagttttaagtataacagattttactgatatgtaaaaattttgccattaaaataaatgatttctcactgagaggaacttttctaccaggttggggcatatgggagcttaatatatcatatctaatttaaaataatttcactgaaataaactccattgcttttacctaatttttttcttgagatgcttttgtagtttttcagagttttagatgattttatacaaaatcctctgcctagcactgctctttttgatgttgtagtgacaccatttacattgaattaatgcttggtagcctggggctagatgtggaactccatggatctgtgttctgactggcacctttggaatgaaagaaaagtgtgtgctgtccaaattttttccccttaattctttccctcatcttctcacccataatagaaattttatttccattgtgagttctgacaagaatgaaattccacatacaacataactgtaaattgttggtaggtagaagttaatatttgtggttcatgtatattttgaccagagtatatttaagtatataatttcagcttccttgatttagaaatatgatataataaagaaaaactccatttatcatctgttaaaaaaaaaaaaaaaaa

SEQ ID NO: 30658 - DNA, 5138 bp, Homo sapiens
gcgcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggaaatctgatgtacctggagtagtaaaaacaggctccacgaaggagctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaactttgcttatttcttttgcagcaataagcatgcataataagtcacagccaaatgcttccatttgtaatcaagttatacataattataaccgagggctggcgttttggaatgcaatttgcacagggattggaacatgatttatagttaaaagcctaatatgcagaaatgaattaagatcattttgttgttcattgtgcagtatgtatatagcataatatacacagtgaattataggtctcaggcttacttgatttttggctattttatatttagtgtacacagggctttgaaatattaatttacataaaggccttcatatattattacgtgttatatattacgtgttataaatttattcaataaatatttgcctagaattcccaagacctttataggtgattttgttttctgggctccttaacttcataaatagctagtatcttccagcagtagtaacagtctggataacttcttccatatccctccctctttgtttttttgagacagtgtcactttgtcacccaggctggagtgcaatggtgtggtctcggctcactgcaacctccacctcccgggttcaagtgattctcccgcctcagcttcctgagtagctggaactacaggcgtgtgccaccacacccggctaatttttcgtatttttagtgtagacggggtttcactatgttgcccaggctggtctcgaactcctgaccgcgtgatccaccacctcagcttcccaaagtggtgggattacaggcgtgagccaccgcacccggcctccatatcccccttttaaaattctgtagtgtatggtaagtcatatcagatatcagacctaatttaaatttcattttagctttacaagtccaaaaacacagaatttatatattcagatactctagcactaattttagtcttaaaatattcccacgatattctgtacacaaaatgttctttttgttacaagagctgagttgcatatactgtagataaatcatattatttttgccaatttcacaaattcctctggcccatcatgtcagtcattattgagtatatgcacacattgctacttatttgattatgtatcttttaaattgattcagtgcatagaaaactatctcttacaaactttaagtgctctgatatgacttcccccccaaattttattatgaacatttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgtatttactttttatgtggccctctctttaggggattctaattttacttagggtctctaagtgcagcataatgttcctgatgttaacagaagactgtatttttaaagttacaaatttgtatatggaattaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggcaatgcaaatgatttttaatctttttttattatcttttcagcagtttatattttttgtgactttatgcaaccatatttttactttgtcttgacaactgaaagatgtataaggttttttgccagaaatgtactgtatacatagttttaagtataacagattttactgatatgtaaaaattttgccattaaaataaatgatttctcactgagaggaacttttctaccaggttggggcatatgggagcttaatatatcatatctaatttaaaataatttcactgaaataaactccattgcttttacctaatttttttcttgagatgcttttgtagtttttcagagttttagatgattttatacaaaatcctctgcctagcactgctctttttgatgttgtagtgacaccatttacattgaattaatgcttggtagcctggggctagatgtggaactccatggatctgtgttctgactggcacctttggaatgaaagaaaagtgtgtgctgtccaaattttttccccttaattctttccctcatcttctcacccataatagaaattttatttccattgtgagttctgacaagaatgaaattccacatacaacataactgtaaattgttggtaggtagaagttaatatttgtggttcatgtatattttgaccagagtatatttaagtatataatttcagcttccttgatttagaaatatgatataataaagaaaaactccatttatcatctgttaaaaaaaaaaaaaaaaa

SEQ ID NO: 30659 - DNA, 2722 bp, Homo sapiens
aagccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtggtatcccgaagcctaatgagcaccgcgatcggcgggtccctggagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcaaaaaaaaaa

SEQ ID NO: 30660 - DNA, 1080 bp, Homo sapiens
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctcgcctcagggctccttcctccagtcttggagcattttttcgaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagc

SEQ ID NO: 30661 - DNA, 4113 bp, Homo sapiens
gggtactccttcctggaccgcgctggaagccctggcggcggcggcccatggggcccttggcgctgcccgcctggctgcagcccaggtataggaagaatgcgtatcttttcatctattacttaatccagttctgtggccactcttggatatttacaaatatgacagtcagattcttttcatttggaaatgattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtacacttatagcatgttatcagtcataggaatatcctatgctgtcttgacatggctcagtcaaacactatggatgccaatttatcctttgtgtgttcttgctgaagcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaataccttgtatttgacaaaaatccattacatgaaataactgcacatacccccaaaactctagacataacaggctatgtttttcacacattgtatttttaagacatatatattctccataccctgcttcaccaaaattcctgcttcatttggattttatacaagttatacttacattgtatgaagtctgattattttcctgtaagtttaatgagaaataggagattagctgcaatagattcaattaaattaagaaaccaaacttgataacctaaattacatgtattctttttcacttccaagttcccaaatagatctgtaggagaagagggatggaaaatatattccacatttgcctagaataacatatttcatagacagatgtctgtcttcagatctaataatactcaccctaaacattagatatgtttagaaaattaaatatctttccaagccctatgtcttagctcaggttgctataatagaacaccataaaccgaatggcttaaacaacagcaaacgcttctcacagttctggaggctgggaattccgctcaggatcaaggcatcagctaatgcagtttctggtgagggccctcttcccagtttgcagatagatgtccttctttgtccccacatgagagagagatcaactctcttatgtctcttataatggcactaaccccattcatgagggctctaccctcatgatctaattacctcccaatggccccacctccaaataccatcatattggaggttagggcttaacacatgaattttgggggaacacaaagattcactccatagcattctgtacctggtcctacaaaattcatgtcctcctcacatgcaaaatacatacattccatctcgacagcctcaaaagtcttaactcattcctgcatcaactctaaagtccaaagtctcatctaaatcagatgtgggtgagattcaaggtagaattcatcctgaggtaaaattcctttccagctttgaacttgtgaaatgaaacaagttatgtgcttccacagtacaatggtgggacacacaaagggtggacattcctattcccaaagcaagaaacaggaaaaaaggaaggtgtaatgggtccccagcaagtgcaaaacctagcaaggcaaacaccatgagatcttcagtcttagtaataatcctctttggcctgatactctggcttcaggacccaatgaggcagaggtattgcccccaggactatgttggaggaggatgacccccatatcaccaggcggaagctgtcaggcctgttgaaaccaaggcaatgactgccccttttgaaactgagaaggtaccactgatgttctctgaatcattgttccgggtcagtttctccttttcttgaagaatagtgtacattcacagctgaatagctctatggtcccaaattcaagaagtccaacagtcttccctcattctgtcccatctccattcctttcaatacaaactagcagtgttcctgctggggtggctgattaggtctgtggttcacacccacataaatctaattggatgactggtctgctacactcttagtgttctctaccaaacgtgttttcttatctttttgtaatgcagacagactgataatttcccacatcttttaagttgtggttccgtttttgttaagaattctgtcttcattttttgtcacattttactttaagcagtcaaggtaaaccgaggcactccttcaacactggttggagatctcttcagttcaatatctaatttcatggctcacaattttactttccacaaaacactagaacatgaacacaatcatccaagttctttggcatattataacaaagatcacctttcttccagtttcccataacaggttcctcattttcatttgagacttcatcagaatggcctttattgtccatgtctaccaacattatcttcatggtgatttacgtgttctctatgaagatggaggctttctctcccaccctcttctctttgagccctcaccaaaatcacctctatcaatcccttcatggcaatactggctttttctagcaaaaaaactagtacctcaaaactcttccagtactcttccaggtactctagtacctcaaaactcttccagcttctatctgttacctaacgtcaaagctgcttccacatctttatatattcgttatagcatcaccacacttcttggtactaattgctgtcttagcttggctgctataacaaaataccataaactgggtggcttagacaacaaatatatttctcacagttctggaggcagggaagtccaagataaaggtgctagacaattaagttcctgatgaggttccaaggtgctagctgattcttcttcatggtttgcagatgaatgccttcttgctatatgttcacatggtggagggagaaaccatctctcccttatttcttattgtaaaggtactaatcccatttatgaaggttccagcttcaaatgccatcacactggagattagattttcaacatgtgaatttaatgggggacaccagcattcagtccctagtgctctgatagagtattcattaatgtcatgtatttgttaacatcttgtaagttatttgggctttgatgccttaaaagaagaccctgacctcatgatccacccgcctcggcctcccaaagtgctgggattacaggtgtgagccactgggcccagcccacctctgtagttctttggaataattttatgattaatttgattagaaactcagttctttggaataattttatgattaatttgattagaaactcagttttttttttttctttaatttttgagacagcctgggtgacagagtgagactctatctcaaaagagaagaccctaatgaaaatagtaaacctttagcaaatacacaaatgatgccccattctgtattctttttaattttaaaaataatgacacacacatacaggaagataaaaggtataaaaatatactaagtactttttaaaaaggaaaattcatgttttggattattactgaattgttgctaattactgtaatgtaagtcatatgtccttacatagttttgaaaaatgctttctttaaaaatctaaaaaaagtgtgaataactggtagtcattgctgtatcattgatgtatcactcaatttttggtaaagaattataaagatcttacctagaaactatgtaaaaaggtattaaatatattgtgatgtaagaataggataataaaaatgtaattttaaaaaaaaaaaaaaaa

SEQ ID NO: 30662 - DNA, 2805 bp, Homo sapiens
gccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgac

SEQ ID NO: 30663 - DNA, 3263 bp, Homo sapiens
ccagaaacagacctgggagtggaacagcagcagttaggagaggaccctgctggggtccaggagcccgcctgcctggctgcccaaccagctccaacactgctggaggcctccattctctgttcaggggaaggcccactggttagctcagagatggcttctgcgtgctttctcccttccgtcctagagaacacatattttctgtttcctcccttgccttctcccacttggacctgctcagagccctgtgtactctggtgtgtggcctctctcccctctctcttttcctccttctggattctttcctatcttcatccacaatctctaccctttatcttgccgttactctaccccgagactgccttctgccctgggtcccaccaaatagatcctgtccttcccttagtgaaaatgaggccacctcttggggaacagaagacgccccagtgaaaacagagtgcaaacctggcctggcatgggagcctccttctggccaatcaggcaggccagagaacagcagcggagggccctgtctttcaggcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgac

SEQ ID NO: 30664 - DNA, 2718 bp, Homo sapiens
gccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgac

SEQ ID NO: 30665 - DNA, 6557 bp, Homo sapiens
agagggcaaggagagagcagagaacacactttgccttctctttggtattgagtaatatcaaccaaattgcagacatctcaacactttggccaggcagcctgctgagcaaggtacctcagccagcatggcagcctctttcccacccaccttgggactcagttctgccccagatgaaattcagcacccacatattaaattttcagaatggaaatttaagctgttccgggtgagatcctttgaaaagacacctgaagaagctcaaaaggaaaagaaggattcctttgaggggaaaccctctctggagcaatctccagcagtcctggacaaggctgatggtcagaagccagtcccaactcagccattgttaaaagcccaccctaagttttcaaagaaatttcacgacaacgagaaagcaagaggcaaagcgatccatcaagccaaccttcgacatctctgccgcatctgtgggaattcttttagagctgatgagcacaacaggagatatccagtccatggtcctgtggatggtaaaaccctaggccttttacgaaagaaggaaaagagagctacttcctggccggacctcattgccaaggttttccggatcgatgtgaaggcagatgttgactcgatccaccccactgagttctgccataactgctggagcatcatgcacaggaagtttagcagtgccccatgtgaggtttacttcccgaggaacgtgaccatggagtggcacccccacacaccatcctgtgacatctgcaacactgcccgtcggggactcaagaggaagagtcttcagccaaacttgcagctcagcaaaaaactcaaaactgtgcttgaccaagcaagacaagcccgtcagcgcaagagaagagctcaggcaaggatcagcagcaaggatgtcatgaagaagatcgccaactgcagtaagatacatcttagtaccaagctccttgcagtggacttcccagagcactttgtgaaatccatctcctgccagatctgtgaacacattctggctgaccctgtggagaccaactgtaagcatgtcttttgccgggtctgcattctcagatgcctcaaagtcatgggcagctattgtccctcttgccgatatccatgcttccctactgacctggagagtccagtgaagtcctttctgagcgtcttgaattccctgatggtgaaatgtccagcaaaagagtgcaatgaggaggtcagtttggaaaaatataatcaccacatctcaagtcacaaggaatcaaaagagatttttgtgcacattaataaagggggccggccccgccaacatcttctgtcgctgactcggagagctcagaagcaccggctgagggagctcaagctgcaagtcaaagcctttgctgacaaagaagaaggtggagatgtgaagtccgtgtgcatgaccttgttcctgctggctctgagggcgaggaatgagcacaggcaagctgatgagctggaggccatcatgcagggaaagggctctggcctgcagccagctgtttgcttggccatccgtgtcaacaccttcctcagctgcagtcagtaccacaagatgtacaggactgtgaaagccatcacagggagacagatttttcagcctttgcatgcccttcggaatgctgagaaggtacttctgccaggctaccaccactttgagtggcagccacctctgaagaatgtgtcttccagcactgatgttggcattattgatgggctgtctggactatcatcctctgtggatgattacccagtggacaccattgcaaagaggttccgctatgattcagctttggtgtctgctttgatggacatggaagaagacatcttggaaggcatgagatcccaagaccttgatgattacctgaatggccccttcactgtggtggtgaaggagtcttgtgatggaatgggagacgtgagtgagaagcatgggagtgggcctgtagttccagaaaaggcagtccgtttttcattcacaatcatgaaaattactattgcccacagctctcagaatgtgaaagtatttgaagaagccaaacctaactctgaactgtgttgcaagccattgtgccttatgctggcagatgagtctgaccacgagacgctgactgccatcctgagtcctctcattgctgagagggaggccatgaagagcagtgaattaatgcttgagctgggaggcattctccggactttcaagttcatcttcaggggcaccggctatgatgaaaaacttgtgcgggaagtggaaggcctcgaggcttctggctcagtctacatttgtactctttgtgatgccacccgtctggaagcctctcaaaatcttgtcttccactctataaccagaagccatgctgagaacctggaacgttatgaggtctggcgttccaacccttaccatgagtctgtggaagaactgcgggatcgggtgaaaggggtctcagctaaacctttcattgagacagtcccttccatagatgcactccactgtgacattggcaatgcagctgagttctacaagatcttccagctagagataggggaagtgtataagaatcccaatgcttccaaagaggaaaggaaaaggtggcaggccacactggacaagcatctccggaagaagatgaacctcaaaccaatcatgaggatgaatggcaactttgccaggaagctcatgaccaaagagactgtggatgcagtttgtgagttaattccttccgaggagaggcacgaggctctgagggagctgatggatctttacctgaagatgaaaccagtatggcgatcatcatgccctgctaaagagtgcccagaatccctctgccagtacagtttcaattcacagcgttttgctgagctcctttctacgaagttcaagtataggtatgagggaaaaatcaccaattattttcacaaaaccctggcccatgttcctgaaattattgagagggatggctccattggggcatgggcaagtgagggaaatgagtctggtaacaaactgtttaggcgcttccggaaaatgaatgccaggcagtccaaatgctatgagatggaagatgtcctgaaacaccactggttgtacacctccaaatacctccagaagtttatgaatgctcataatgcattaaaaacctctgggtttaccatgaaccctcaggcaagcttaggggacccattaggcatagaggactctctggaaagccaagattcaatggaattttaagtagggcaaccacttatgagttggtttttgcaattgagtttccctctgggttgcattgagggcttctcctagcaccctttactgctgtgtatggggcttcaccatccaagaggtggtaggttggagtaagatgctacagatgctctcaagtcaggaatagaaactgatgagctgattgcttgaggcttttagtgagttccgaaaagcaacaggaaaaatcagttatctgaaagctcagtaactcagaacaggagtaactgcaggggaccagagatgagcaaagatctgtgtgtgttggggagctgtcatgtaaatcaaagccaaggttgtcaaagaacagccagtgaggccagaaattggtcttgtggttttcatttttttcccccttgattgattatattttgtattgagatatgataagtgccttctatttcatttttgaataattcttcatttttataattttacatatcttggcttgctatataagattcaaaagagctttttaaatttttctaataatatcttacatttgtacagcatgatgacctttacaaagtgctctcaatgcatttacccattcgttatataaatatgttacatcaggacaactttgagaaaatcagtccttttttatgtttaaattatgtatctattgtaaccttcagagtttaggaggtcatctgctgtcatggatttttcaataatgaatttagaatacacctgttagctacagttagttattaaatcttctgataatatatgtttacttagctatcagaagccaagtatgattctttatttttactttttcatttcaagaaatttagagtttccaaatttagagcttctgcatacagtcttaaagccacagaggcttgtaaaaatataggttagcttgatgtctaaaaatatatttcatgtcttactgaaacattttgccagactttctccaaatgaaacctgaatcaatttttctaaatctaggtttcatagagtcctctcctctgcaatgtgttattctttctataatgatcagtttactttcagtggattcagaattgtgtagcaggataaccttgtatttttccatccgctaagtttagatggagtccaaacgcagtacagcagaagagttaacatttacacagtgctttttaccactgtggaatgttttcacactcatttttccttacaacaattctgaggagtaggtgttgttattatctccatttgatgggggtttaatgatttgctcaaagtcatttaggggtaataaatacttggcttggaaatttaacacagtccttttgtctccaaagcccttcttctttccaccacaaattaatcactatgtttataaggtagtatcagaatttttttaggattcacaactaatcactatagcacatgaccttgggattacatttttatggggcaggggtaagcggcttttaaatcatttgtgtgctctggctcttttgatagaagaaagcaacacaaaagctccaaagggccccctaaccctcttgtggctccagttatttggaaactatgatctgcatccttaggaatctgggatttgccagttgctggcaatgtagagcaggcatggaattttatatgctagtgagtcataatgatatgttagtgttaattagtttttcttcctttgattttattggccataattgctactcttcatacacagtatatcaaagagcttgataatttagttgtcaaaagtgcatcggcgacattatctttaattgtatgtatttggtgcttcttcagggattgaactcagtatctttcattaaaaaacacagcagttttccttgctttttatatgcagaatatcaaagtcatttctaatttagttgtcaaaaacatatacatattttaacattagtttttttgaaaactcttggttttgtttttttggaaatgagtgggccactaagccacactttcccttcatcctgcttaatccttccagcatgtctctgcactaataaacagctaaattcacataatcatcctatttactgaagcatggtcatgctggtttatagattttttacccatttctactctttttctctattggtggcactgtaaatactttccagtattaaattatccttttctaacactgtaggaactattttgaatgcatgtgactaagagcatgatttatagcacaacctttccaataatcccttaatcagatcacattttgataaaccctgggaacatctggctgcaggaatttcaatatgtagaaacgctgcctatggttttttgcccttactgttgagactgcaatatcctagaccctagttttatactagagttttatttttagcaatgcctattgcaagtgcaattatatactccagggaaattcaccacactgaatcgagcatttgtgtgtgtatgtgtgaagtatatctgggacttcagaagtgcaatgtatttttctcctgtgaaacctgaatctacaagttttctgccaagccactcaggtgcattgcagggaccagtgataatggctgatgaaaattgatgattggtcagtgaggtcaaaaggagccttgggattaataaacatgcactgagaagcaagaggaggagaaaaagatgtctttttcttccaggtgaactggaatttagttttgcctcagatttttttcccacaagatacagaagaagataaagatttttttggttgagagtgtgggtcttgcattacatcaaacagagttcaaattccacacagataagaggcaggatatataagcgccagtggtagttgggaggaataaaccattatttggatgcaggtggtttttgattgcaaatatgtgtgtgtcttcagtgattgtatgacagatgatgtattcttttgatgttaaaagattttaagtaagagtagatacattgtacccattttacattttcttattttaactacagtaatctacataaatatacctcagaaatcatttttggtgattattttttgttttgtagaattgcacttcagtttattttcttacaaataaccttacattttgtttaatggcttccaagagcctttttttttttgtatttcagagaaaattcaggtaccaggatgcaatggatttatttgattcaggggacctgtatttccatgtcaaatgttttcaaataaaatgaaatatgagtttcaatactttttatattttaatatttccttaatattatggttattgtccgccattttgttgtatattgtaaataaagtttagattgt

SEQ ID NO: 30666 - DNA, 2414 bp, Homo sapiens
actctctttacagtcagccttctgcttgccacagtcatagtgggcagtcagtgaatcttccccaagtgctgacaattaatacctggtttagcggcaaagattcagagaggcgtgagcagcccctctggccttcagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaagtatgggtgctctctttggaggacgctcatacatgccttctacccacagaaccacagaaaaatggaatagtgtagctgactgcctgccctgtgttttcctggtggattttgaatttgggtgtgctacatcatacattcttccagaacttcaggatgggctatcttttcatgtctctattgccaaaaatgacaccatctatattttaggaggacattcacttgccaataatatccggcctgccaacctgtacagaataagggttgatcttcccctgggtagcccagctgtgaattgcacagtcttgccaggaggaatctctgtctccagtgcaatcctgactcaaactaacaatgatgaatttgttattgttggtggctatcagcttgaaaatcaaaaaagaatgatctgcaacatcatctctttagaggacaacaagatagaaattcgtgagatggagaccccagattggaccccagacattaagcacagcaagatatggtttggaagcaacacgggaaatggaactgtttttcttggcataccaggagacaataaacaagttgtttcagaaggattctatttctatatgttgaaatgtgctgaagatgatactaatgaagagcagacaacattcacaaacagtcaaacatcaacagaagatccaggggattccactccctttgaagactctgaagaattttgtttcagtgcagaagcaaatagttttgatggtgatgatgaatttgacacctataatgaagatgatgaagaagatgagtctgagacaggctactggattacatgctgccctacttgtgatgtggatatcaacacttgggtaccattctattcaactgagctcaacaaacccgccatgatctactgctctcatggggatgggcactgggtccatgctcagtgcatggatctggcagaacgcacactcatccatctgtcagcaggaagcaacaagtattactgcaatgagcatgtggagatagcaagagctctacacactccccaaagagtcctacccttaaaaaagcctccaatgaaatccctccgtaaaaaaggttctggaaaaatcttgactcctgccaagaaatcctttcttagaaggttgtttgattagttttgcaaaagcctttcagattcaggtgtatggaatttttgaatctatttttaaaatcataacattgattttaaaaatacatttttgtttatttaaaatgcctatgttttcttttagttacatgaattaagggccagaaaaaagtgtttataatgcaatgataaataaagtcattctagaccctatacattttgaaaatattttacccaaatactcaatttactaatttattcttcactgaggatttctgatctgattttttattcaacaaaccttaaacacccagaagcagtaataatcatcgaggtatgtttatatttattatatgagtcttggtaacaaataacctataaagtgtttatgacaaatttagccaataaagaaattaacacccaaaagaattaaattgattattttgtgcaacataacaattcggcagttggccaaaacttaaaagcaagatctactacatcccacattagtgttctttatataccttcaagcaaccctttggattatgcccatgaacaagttagtttctcatagctttacagatgtagatataaatataaatatatgtatacatatagatagataatgttctccactgacacaaaagaagaaataaataatctacatcaaaaaaaaaaaaaaaaaaaaaaaaaaaa

SEQ ID NO: 30667 - DNA, 1337 bp, Homo sapiens
gctgcataaggactgcccggggctgcgcgccgggaacctcgcggggctggcgggcgccgcaccccctccctggccgcctgcgccccggggaggccgcccgcgcgcgacgggaccggcagcatgagcagcggctacagcagcctggaggaggacgccgaggacttcttcttcaccgccaggacctccttcttcaggagagcgccccagggcaagccccgctccggccaacaagatgttgagaaagagaaggaaacccacagttacctcagcaaagaggagatcaaagagaaagttcataaatacaacttagcagtcacagacaagttgaagatgaccttgaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaagtctacgcctgcaagctctcagaccgggaacatccactctacctgcgtttggtagcagggcccagaacagacacacttagttttgttcttcgtgaacatgaaattggagagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgcttggaagcatgaactctgggggtgtttttttttttggttattttaattatgtgatgatgctgttaagcttacagatatgcagttgattttttaaaaagcttaactaggaatctttctgaatacttgtcctattttgaaactacctgtctggttttttgtttggttttgttttctttttttaatgtcagaggaatctatccatgtgaatcgaaaggcacaggaatctaggaa

SEQ ID NO: 30668 - DNA, 1516 bp, Homo sapiens
gccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataaaaaaaaaaaaaaaaaaaa

SEQ ID NO: 30669 - DNA, 1901 bp, Homo sapiens
ggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaaaaaaaaaaaaaaaa

SEQ ID NO: 30670 - DNA, 2038 bp, Homo sapiens
ggcccgcgggactcagaccagcggggagcgcggcctccgcccttggggccctcccgccgggccggagacccaagcccccaacgccaggccctgccctggaagcgctcgcggcccggcgcctggacgggggagttgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaaaaaaaaaaaaaaaaaaaaaaaaaaa

SEQ ID NO: 30671 - DNA, 1963 bp, Homo sapiens
gagcggcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaaaaaaaaaaaaaaaaaaaaaaaaaaa

SEQ ID NO: 30672 - DNA, 10693 bp, Homo sapiens
cgacagctctgactccatctagcgcggcggcggcggagcctgagggagcgagcgaggagagaggcgcgtccacctggcgggcccagcgtatggagctgaggcagaggcggcggcggcggcggcagcagtagcagcggcggtggcggctaaggcagctcgaacagctgcggcgacggcgacagcccagccttgactgcgaccgcgctagctacagcgcctgctgcctgagcccgccagcgacgtgcgcctcgggagtcggcctgtgaggttggacagcatttggacttggaatgaaacaataagaggttatattcatggataaccaacaagataaggctattgttgcctcagccaacggagaaaacactctgattaatggggtcaaagaaaatgactcagaggaccaggatgtggcaatgaagtcatttgcagctctagaagctgctgcacctatccagcctacaccggtggcacaaaaagagaccctgatgtatcccagaggtctcctgcctctaccctctaagaagccctgtatgcagagcccgccctctcctttgggcctgattgaagcacccgaacatgctgctaatagtgcttctgtgaatgccatctccctcacatctggcattgcaaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgtatatatttttacttctatatcaacatttggttgtatttggggaagttgtccctgttaatttactagaaacattccagtgattcttgctattaaccacccccacttatgtggatagcacctgtagatcatggtggaaaaatatgttgtgttacacaatttaccaaaattaaaggatactgtttgaaatgtgccaaattttcttacctcatctcacagattcacccacagtttaaagctcattaattatttttaaatggatatatacacacccaaacatatatatgtatatgtttgtgtgtgtgtgtgtgtgtgtatatatatgtatatatatatatacacacacacacgttcttttaaagttttagactctactgtcctgtgtggaaacatgaacagctaaacaaggcaaaataaagattttcttgttccattgtgtaagggttaaaattttggaaaagtctgaaggccacaacagctaagtccatcagggacccaagtatatgcatttacagaacgttttacaaggaaacaaaacagctgctttcaaagtttgttttctaaaagcaaaatctgtagctgaaaattatttaaagtgcaaagttatattgctgatactttatatctcagttttatatattttataatagtctgggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagttt

SEQ ID NO: 30673 - DNA, 1980 bp, Homo sapiens
agacactggacttgtaaacgaaaagcttcataagtccctctttgcttagtacttttctcgtcctttccccagggtgcacgtaaccctcaagcactaggaccgtgcggaatccaggctgcgatggcaccttcatttaccgcccgcattcagttgttcctcttgcgggcgctaggctttctcataggcttagtaggccgagcagctttagtcttagggggtccaaagtttgcctcaaagacccctcggccggtgactgaaccattgcttctgctttcggggatgcagctggccaagctgatccgacagagaaaggtgaaatgtatagatgttgttcaggcttatatcaacagaatcaaggacgtgaacccaatgatcaatggaattgtcaagtacaggtttgaggaagcgatgagggaggctcatgctgtagatcaaaagcttgcagagaagcaggaagatgaagccaccctggaaaataaatggcccttccttggggttcctttgacagtcaaggaagctttccagctacaaggaatgcccaattcttctggactcatgaaccgtcgtgatgccattgccaaaacagatgccactgtggtggcattactgaagggagctggtgccattcctcttggcataaccaactgtagtgagttgtgtatgtggtatgaatccagtaacaagatctatggccgatcaaacaacccatatgatttacagcatattgtaggtggaagttctggtggtgagggctgcacactggcagctgcctgctcagttattggtgtgggctctgatattggtggtagcattcgaatgcctgctttcttcaatggtatatttggacacaagccttctccaggtgtggttcccaacaaaggtcagtttcccttggctgtgggagcccaggagttgtttctgtgcactggtcctatgtgccgctatgctgaagacctggcccccatgttgaaggtcatggcaggacctgggatcaaaaggttaaaactagacacaaaggtacatttaaaagacttaaaattttactggatggaacatgatggaggctcatttttaatgtccaaagtggaccaagatctcattatgactcagaaaaaggttgtggttcaccttgaaactattctaggagcctcagttcaacatgttaaactgaagaaaatgaagtactcttttcagttgtggatcgcaatgatgtcagcaaagggacatgatgggaaggaacctgtgaaatttgtagatttgcttggtgaccatgggaaacatgtcagtcctctgtgggagttgatcaaatggtgcctgggtctgtcagtgtacaccatcccttccattggactggctttgttggaagaaaagctcagatatagcaatgagaaataccaaaagtttaaggcagtggaagaaagcctgcgtaaagagctggtggatatgctaggtgatgatggtgtgttcttatatccctcacatcccacagtggcacctaagcatcatgtccctctaacacggcccttcaactttgcttacacaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaaccaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctg

SEQ ID NO: 30674 - DNA, 3263 bp, Homo sapiens
ggcatcactcgagcccaggtcccagtcatcaccactcacagcgctcggcgttcaggaagaggagcaccagcggagcgcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaagcacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaa

SEQ ID NO: 30675 - DNA, 970 bp, Homo sapiens
ctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataatattttaattgctcagtgatgttccataacccggctggctcagctggagtgctgggagatgagggcctcctggatcctgctcccttctgggctctgactctcctggaaatctctccaaggccagagctatgctttaggtctcaattttggaatttcaaacaccagcaaaaaattggaaatcgagataggttgctgacttttattttgtcaaataaagatattaaaaaaggcaaaaaaaaaa

SEQ ID NO: 30676 - DNA, 2496 bp, Homo sapiens
cagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggaaccctgcagagctcacagggcccaggacaccaacgccgcataggaccgcccacatgggaacgcccacatgggaccgcccacataggaccgcccacataggaccgcccacatgggaccgcccacatagaaccgcccacataggaccgcccacatgggaacgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcgggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattaactcagggtttcagctccaacctcgctgagttggtgcagctccgggtcattcctggggtgggaatcggatcatccctgactcagcttataccttaattttatttgcagaggattcttttctcaaaatgctctggcatttggacacacatcacatgtcgatatttgcataggagtcattttcagtggaataacatttttaatgtgtggttttacggttcaaggaactacatgatgattttgaggaaacacttgccagaaactaaattaacgaataaaagatttcagtgcccgaaaaaaaaaaaaaaaaaa

SEQ ID NO: 30677 - DNA, 2425 bp, Homo sapiens
gggcgctggtggcggcggtggcggaggtggaggtggaggtggaagctgaagctgaagcagagccagaggcggcgcggcggggtgctcggcggcgcggcacgcggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagtatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcaggggatggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatataaaaatgccacggtcctgctctggtcaataaaggatcctttgttgataaaaaaaaaaaaaaa

SEQ ID NO: 30678 - DNA, 1912 bp, Homo sapiens
ccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaatttttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcaaaaaaaaaaaaaaaaaaaaaaa

SEQ ID NO: 30679 - DNA, 1889 bp, Homo sapiens
ccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggca

SEQ ID NO: 30680 - DNA, 3527 bp, Homo sapiens
agtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggaaaaaaaaaaaaaaaaaa

SEQ ID NO: 30681 - DNA, 3095 bp, Homo sapiens
agtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggaaaaaaaaaaaaaaaaaa

SEQ ID NO: 30682 - DNA, 1001 bp, Homo sapiens
agtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatataggtaaatatacgttctgcatccaaatgcactttgagattgttacgatttattctgagcaagatctgcattttttgaaagtttgagattgtagttatcttttttgagatgagatactttcacgactttggtatcatctgtcagtttttgcccagtgagttctgcatttgcagctccttgttttggtctgttcgtaactgcagtgttctccatgagtatcaggaaggtagggtttcacttaggagtaagaacagtccccagtccagcagccacccttttcagctgctgttcattgccagttgatgaggtgagtgtcatctgcctctctggacaggccccagtggagaacaccgcaggtactgtaaaccaagtacttttcacagcgtggcctttcaccataattttatatttctccccctaaaatgtggtcttttactttttataggtactttctgaaaaaaaaaaaa

SEQ ID NO: 30683 - DNA, 2890 bp, Homo sapiens
agtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggaaaaaaaaaaaaaaaaaa

SEQ ID NO: 30684 - DNA, 2158 bp, Homo sapiens
ccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaaaaaaaaaaaaaaa

SEQ ID NO: 30685 - DNA, 2530 bp, Homo sapiens
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaagaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttatttaaaaaaaaaaaaaaaaaaaaaaaaaaaaaaaaaaaaaaaaaaaaaaaaaaaaaaaaaaaaaaaaaaaaagaaaaaaa

SEQ ID NO: 30686 - DNA, 1789 bp, Homo sapiens
ggttcaggaacctgctggttctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggcccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactgataataaaaatcagactgaaagccaggacatctgagtacctatctcacacactgaccaccagtcacaaagtctggaaaagtttacattttggctatctttactttgttctgggagctgatcatgataacctgcagacctgatcaagcctctgtgcctcagtttctctctcaggataaagagtgaatagaggccgaagggtgaatttcttattatacataaaacactctgatattattgtataaaggaagctaagaatattattttatttgcaaaacccagaagctaaaaagtcaataaacagaaagaatgattttgagaaa

SEQ ID NO: 30687 - DNA, 2807 bp, Homo sapiens
caggttgggttctgggacaggtgacccggcggcggggcgaggcagctggcggcgtcgcatggagggctctgggggcggtgcgggcgagcgggcgccgctgctgggcgcgcggcgggcggcggcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaaattaataaactgttacttatatttaagaaagtgaggattttttttttttaaagataaaagcatggtcagatgctgcaaggattttacataaatgccatatttatggtttccttcctgagaacagtcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacagggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagccacatttttgtattgttactgtacgtgtatctggggcttctccgtttgttaatactttttctgtatttgttgctgtatttttggcataactttattataaaaaaaaaaaaaaaaaaaaaaaaaaaaaaaaaaaaaa

SEQ ID NO: 30688 - DNA, 2266 bp, Homo sapiens
atccggcctcgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagca

SEQ ID NO: 30689 - DNA, 2203 bp, Homo sapiens
atccggcctcgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagca

SEQ ID NO: 30690 - DNA, 2461 bp, Homo sapiens
atccggcctcgcacttccggtggggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagca

SEQ ID NO: 30691 - DNA, 5071 bp, Homo sapiens
gtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaaaaaaaaaaaaaaaaaaaa

SEQ ID NO: 30692 - DNA, 5142 bp, Homo sapiens
taggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaaaaaaaaaaaaaaaaaaaa

SEQ ID NO: 30693 - DNA, 5297 bp, Homo sapiens
caacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaaaaaaaaaaaaaaaaaaaa

SEQ ID NO: 30694 - DNA, 1700 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaa

SEQ ID NO: 30695 - DNA, 1489 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaa

SEQ ID NO: 30696 - DNA, 3999 bp, Homo sapiens
atgcagcaggcgccgcagccttacgagttcttcagcgaggagaacagtccgaaatggcggggactgttggtctcggccctgcggaaggttcaggttcaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaaccctgttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgtatacgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatcaccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacactagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttagggtacttaatgtattccgccattgggttgaccatcattattatgactttgaaagagacctggaattgctggaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttgatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaagaaagggaaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatga

SEQ ID NO: 30697 - DNA, 664 bp, Homo sapiens
accaaacccaagggaccacacagcccattctgctccgtataccagaaaaaaacacatttgaagcatgaattctcagcagcagaagcagccttgcaccccaccccctcagcctcagcagcagcaggtgaaacaaccttgccagcctccaccccaggaaccatgcatccccaaaaccaaggagccctgccaccccaaggtgcctgagccctgccaccccaaagtgcctgagccctgccagcccaaggttccagagccctgccagcccaaggtgcctgagccctgcccttcaacggtcactccagcaccagcccagcagaagaccaagcagaagtaatgtggtccacagccatgcccttgaggagctggccactggatactgaacaccctactccattctgcttatgaatcccatttgcctattgaccctgcagttagcatgctgtcaccctgaatcataatcgctcctttgcacctctaaaaagatgtcccttaccctcattctggagggctcctgagcctctgcgtaaggctgaacgtctcactgactgagctagtcttcttgttgctcgggtgcatttgaggatggatttggggaaggatcaagtgaaccatccctagtcttccttcaataaataacttttaactccaaaaaaaaaaaaaaaaa

SEQ ID NO: 30698 - DNA, 3257 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaacttcgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaaaaaaaaaaaaaaaaaaaaaaaaaaaaaaaaaaaaaaaaaaaaaaaaaaaaaaaaaaaaaaaaaaaa

SEQ ID NO: 30699 - DNA, 3283 bp, Homo sapiens
cccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 30700 - DNA, 2821 bp, Homo sapiens
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 30701 - DNA, 2917 bp, Homo sapiens
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 30702 - DNA, 2944 bp, Homo sapiens
cctccaggtccttcccctaaaacttggcactgccgatactcccagcccgttccttcccaagtcaggaacttgcaggggaccccttggcaattctttttctctcaagagcagacagccttcagtcccagccgctgccagggctggtgtgtctgacccagctgtggtttttccaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 30703 - DNA, 3413 bp, Homo sapiens
agcgggactggcgggagacggcggcttgcgagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcatgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttatctgtatggagacctcgccatctatgctgctgccgtgcccttctccctcatgcaggtgacctgcagcgccactggcaatgactcctgcggtgtggaagcagacaccaaatacaatgacactgaccggtgttgggggcccctgcgccgagtggacgcctaccgcatctacttggcgatcttcactctcctcctcggaccgttcaccttctttgacgtccagaagaccaagtacctgcagatcctgacctctctgatgagatggatcgctttcgccgtcatgattgtgctggccctgatccgcatcgggcacggacaaggggaggggcacccgcccctggctgacttctcgggggtccggaacctgtttggggtgtgcgtctactccttcatgtgccagcactctctgccatccctcattacccccgtctcctccaagcgccacctcacaaggctggtgttcctggactacgtgctgatcctggccttctacggcctcctctccttcaccgccatcttctgcttccgcggcgacagcctcatggacatgtacaccctcaacttcgcgcgctgtgacgtcgtgggcctggccgctgtgcgctttttcctgggcctcttccccgtcttcaccatcagcaccaacttccccatcattgccgtgaccctgcgcaacaactggaagacactcttccaccgcgagggcggcacgtacccgtgggtggtggaccgcgtcgtgtttcccaccatcaccctggtgccgcctgtgctggtggccttctgcacccacgacctggagtccctggtgggcatcacaggggcctacgcgggcaccggcatccagtacgtcatccccgccttcctggtgtaccactgccgcagggacacccagctggcctttggctgtggggtcagcaacaagcacaggtcccctttccgccacaccttctgggtgggcttcgtgctgctctgggctttctcctgcttcattttcgtcacggccaatatcatcctcagcgagaccaagctctgatggcaggacaggcaggtctagtgacaggaggcataggggccccagccccacccctcgcccgcagagcccagatttagttgctcccaggtcttcatggggcaggtgggactgtggctctaggggaaaccccctgtccagctggggttgttctccccacccaccttccacccagtctgcacctgtcctcactcccccgggcagctctcccaccaggtccttctgcctgggtgacgcgtggctgctcccaagttctaagactcattactggaatcacacctctcccacatcttccaacacgcttcacccccaaccctacttccagggcgggctactccctgcacaatgggagatgcagtgctggcactgccatcatttgtcccagacccatgcccctcccctctcctgccccatcctgcgtccttgtctaagaaacctccactagcagctgctgcctcttcagaggcgaatcccaggctggaagtatcctagccaggtctgcctgtgacggcagggcccaccctcccaccaggcctgggaggcggtaggtgccacctcagagagggcctggctggccccatgacaagaacaagaagtgctaactggtaccagagtccccagatagagctgcgagggccctcgctgtgggcgcgagctccggagtagcaggctggatggagcatcccttctacagggacacggccgcctgccagctgggcctaaagtctggagcttgtctctgaaagggaccgtctgctgccctcgctgccccactggagccctcagggcctcctacagtgcaggtggtcctactagagggaagccatccccacctggcacctcagcggcttggcagtgacatggcagtgggagggctctgaggttcccaccctgacaatggtcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctgcctctctggggtgggtctcaggccccacccctccctcttttgagttcagtgccttgctcagcccctcccctgtatctcagcgtcttgagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaactcaaaacatctggaactacccttctccaattacgttccctcttgcttaaagacaaagctaattaaatcatcctgccacccgaggctccaaaccaaaaaaaaaaaaaaaa

SEQ ID NO: 30704 - DNA, 1586 bp, Homo sapiens
tccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactctgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctgaaaaaaaaaaaaaaaa

SEQ ID NO: 30705 - DNA, 5318 bp, Homo sapiens
agcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggctggtactcagctgaatcgatcaccgttgcttggtccaggtaggaaagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgccgagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggcgctgccatcatcagcaccaggagagccgacccctcccgggacccctcccggctgggcggccccacagacccgctggaacccagcagcggccgc

SEQ ID NO: 30706 - DNA, 4131 bp, Homo sapiens
ggtgcgcgccgcggcttgggggagagttgagcgcttttcccccctcttttttttttttttcctcttcttcttaaacaaaccacaaacggatgtgagggaaggaaggtgtttcttttactcctgagcccagacacctcactctgttccgtctaagcttgttttgctgaacacttttttttaaaaaaggaaaaagaaaaggagttgcttgatgtgagagtgaaatggacgtaagattttatccacctccagcccagcccgccgctgcgcccgacgctccctgtctgggaccttctccctgcctggacccctactattgcaacaagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctgaatgaagttgagtctggttaccattctctgtgtcaccccatgaaccataatggcctgctaccatttcatccacaaaacatggacctccctgaaatcacagtctccaatatgctgggccaggatggaacactgctttctaattccatttctgtgatgccagatatacgaaacccagaaggaactcagtacagttcccatcctcagatggcagccatgagaccaaggggccagcctgcagacatcaggcagcagccaggaatgatgccacatggccagctgactaccattaaccagtcacagctaagtgctcaacttggtttgaatatgggaggaagcaatgttccccacaactcaccatctccacctggaagcaagtctgcaactccttcaccatccagttcagtgcatgaagatgaaggcgatgatacctctaagatcaatggtggagagaagcggcctgcctctgatatggggaaaaaaccaaaaactcccaaaaagaagaagaagaaggatcccaatgagccccagaagcctgtgtctgcctatgcgttattctttcgtgatactcaggccgccatcaagggccaaaatccaaacgctacctttggcgaagtctctaaaattgtggcttcaatgtgggacggtttaggagaagagcaaaaacaggtctataaaaagaaaaccgaggctgcgaagaaggagtacctgaagcaactcgcagcatacagagccagccttgtatccaagagctacagtgaacctgttgacgtgaagacatctcaacctcctcagctgatcaattcgaagccgtcggtgttccatgggcccagccaggcccactcggccctgtacctaagttcccactatcaccaacaaccgggaatgaatcctcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttacttgagaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaaaataaaaagtattcccaagtgattttaatttaaaaacaaattggctttgtctcattgatcagacaaaaagaaactagtattaagggaagcgcaaacacatttattttgtactgcagaaaaattgcttttttgtatcactttttgtgtaatggttagtaaatgtcatttaagtccttttatgtataaaactgccaaatgcttacctggtattttattagatgcagaaacagattggaaacagctaaattacaacttttacatatggctctgtcttattgtttcttcatactgtgtctgtatttaatctttttttatggaacctgttgcgcctatttatgaaataataaatataggtgtttgtaagtaaatttgttagtatttgaaagaggtttctttgatgttttaacttttgctggcaaaaaaaaattcacgcttggtgtgaatactttattatttagtttttacagtaacatgaataaagccaaacctgcttttcatttagcagcaaattaaagtaaccagtccttatttctgcatttctttggttgatgcaaacaaaaaactattatatttaagaactttatttcttcatacgacataacagaattgccctccaagtcacacaagctccaagactaaacaaacagacaggtcctctgtcttaaaaaggttacttcttggttctcagctggttctagtcaattctgaaccaccaccccccgccccccgcaaaaaagtaaaagtcaaaccaaacttcctcaagctgcatgcttttcacaaaatccagaaagcatttaagaattgaactaggggctggaagaagtgaaagggaagcatctaaaaatgaaaggtgagtaaccagatagcaaaagaaaagggaaagccatccaaatttgaaagctgttgatagaaattgagattcttgctgtcttttgtgcctctacaagctactactcattccagaattcctgggtcttccaagaggattcttaaggtaccagagatttgctagggaaccaaaagtgcttgagaatctgcctgagggcttgcatagctttcacattaaaaaaagaaaaagctagcagatttactcctttttaggggatcatatcaagaaagttagtctggttggaaaccaagagaatggctgatgtctctttcttggaatatgtgaaataaatttagcagtttaactaaatacaaatatatgcattgtgtaatccactcagaattaaacagacaaaaggtatgcttgctttggaatgattttaggcattgtacaaccttgaatcacttgagcatgtaataactaataaataatgcagatccatgtgattattaaaatgactgtagctgagagctctaattttcctgtcttgaaactgtataagaactcatgtgattaagttcacagtttattgtttgtctgtttagtattttagaaatataccagcactactaattaactaatgtcttttatttattatattatgataaagtaaaaatttcacttgcattaagtctaaactgagaaggtaattactgggaggagaatgagcagctttgactttgacaggcggtttgtgcaggaaagcacagtgccgtgttgtttacagcttttctagagcagctgtgcgaccagggtagagagtgttgaaattcaataccaaatacagtaaaaacaaatgtaaataaaagaaaacacatcatcaataaaactgttattatgcgtg

SEQ ID NO: 30707 - DNA, 3409 bp, Homo sapiens
gccttccgcaaactcctgacctgtgggtccatccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcattttacctgtt

SEQ ID NO: 30708 - DNA, 3215 bp, Homo sapiens
ttcggcctgggtggaggacgcggctgcttcaagtccttggctctgatccaggccacagattccaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcattttacctgtt

SEQ ID NO: 30709 - DNA, 3490 bp, Homo sapiens
gccttccgcaaactcctgacctgtgggtccatccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatgtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaaaaaaaaaaaaaaaaaaaaaaaaaaaaaaaa

SEQ ID NO: 30710 - DNA, 2984 bp, Homo sapiens
ggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccattttaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccctatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcaaataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggtactgtatatattgtagacttgttttctctgttttatgctcttgtgtaatctacttgacatcattttactcttggaatagtgggtggatagcaagtatattctaaaaaactttgtaaataaagttttgtggctaaaatgacactaaaaaaaaaaaaaaaaaa

SEQ ID NO: 30711 - DNA, 1285 bp, Homo sapiens
tcccccatcccagcccgccccctcggccgctccgcgtccctggcgtgactcggcactgagagtcccgggagaagactcggcggtcgcacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaaaaaaa

SEQ ID NO: 30712 - DNA, 2378 bp, Homo sapiens
gtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaa

SEQ ID NO: 30713 - DNA, 2492 bp, Homo sapiens
gtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcaggcacttccgtttcccgcttctggattttcagccaggtgcctggacatggccctaacctgaggctgagcaatttaactagagcctccttcgtgagccactacatccttcaaaaatactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaa

SEQ ID NO: 30714 - DNA, 1260 bp, Homo sapiens
gggggtggggtccccggggcggggcggggcgcgctgtgtcgcgggtcggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaattctgg

SEQ ID NO: 30715 - DNA, 1269 bp, Homo sapiens
aagactggaacccgtatgagcgccccccagcgcccctgagcgctcgccgccggtgcacggcgcaccccgcgggaggcagggatcagcaaagccgtgcgccccgaggcccgcccccgtctccgcacaaagaccgagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaattctgg

SEQ ID NO: 30716 - DNA, 4368 bp, Homo sapiens
ggcggcgcagttgcgagcgcaggtgagttccgggccgccaccggctgcttctgtgggccgggcctctgagcattggcgacccccgcccggctccgggctgacagggcctggcttcgccaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 30717 - DNA, 4490 bp, Homo sapiens
caggcggcggcggcgcagttgcgagtgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatccttcgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggatgatgacctgaaacctcgaggcctcacgggcatgaagaacctcgggaactcctgctacatgaacgccgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagcctcgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctgtaagtcgccccggctggtccctccatggcactctgggtcctctcctcactctccagagaccctcacatgtccttttgaacatccaaagagcaggtccctgaaagcaccttcctggaggatgtgggagggccctggacatggcccggccccactgctgagtgcccgtgtccccacagccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccgcctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgttaaaaaaaaaaaaaaaaaaaaaaaaaaaaaaaaaaa

SEQ ID NO: 30718 - DNA, 7971 bp, Homo sapiens
ctaaaaataccattaagtaatagtattagcttttgtattctgagattcaacagcagcagtcacttccctccactcctatgtgtatcccaggaccaccctgggcggggagggctgaggtcagggaggtctgaagctggtcctgggctccgggggtgacagtgatgaggaactgggtgcacacatgagtggggcagccgggcctggccagagaagcaacacacacgtgcacagacatgtttatccacatacacatgtgcacgcatgtgcacaaacacattgcaggcaggcatgttgacgcctcaggcagcggaggaccctgactctgggccctgctgacccaggcaaggccccattgtgatgcgtgccatgacctcagaatgtcactggtgcttagcacctatccgctctccagactgcgtctgtgttctacggcagttacacacacgcagtggtattcacaagcggttttgtggactcaaaggttttctccctgagaggcataacccaggccagctgattcatcagaatcaggtgagtgtgacctgctctcttccctccaggctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccaaatgtacccattcgacaggtgagccgtctggggtcagagaggcagtaactggcctgggaatccagacaagaccctgggttttgctctcagccctgctgtgtgccatgctagacttcaggcctcaaccctgagacctccctgctctagatcccaaatctgcccagatttccgatcccaatggggcagagcctggccctggcagagacactgggatggatccactgtgggtggggaggagggaagggtcctcagaacacacctggggcctaagctgggtcttgatggtcactgtgggacccactggacacacacagtcccttgtctgggagtggcatggggagccttctgcccttgggcagttgtggaaagtgaaggagccctggagagctggctgaggggagactatcttcccttgtgttcaaaggggtccaggcactggggctctccccaagtatttcttattctgtctggcctcgctttccttttgccctgagtattctcaggagggacggtccatctagatgtcctccaggagcaaggacccactgttcttcatcagtgacccaggaaaatgaagccccctcctgtggggacagctcagaatggtggagtccacagtccctccctgagagacatggtttccatgagcacagtggctgctttggagacagtaatcattttcatccccaaaaccaaacacactcctgctcaaatggtgttattgctaaagcagcttcactggttagactgaagggccatggtagcccaagtgatgagcggggtagaatggagcagtcaggagagatcttgttccccgtaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaatggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagaactttcctcaggataaccaaaaagtacaactctcagtgagcggatttttgtgtgcatttgaaattcctgtcccttcatctccaatttcagcttctagtccaacacaaatagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccggaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggaactcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctctatgtgctgtttttcctcatacaagtaaacacagaaagtc

SEQ ID NO: 30719 - DNA, 11141 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaaggcacacattcaggggagttcatatatggcttggagaactttgtttacaaggacatcaagcctggacgtaaacgtaaaaagcacaaaaaacattttaagaaaccttttaaaggtcttgatcgttcaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagcaagaactggaaatacaggaataaatgtttcctaaactactacttgatttcatccttaaaaatcaaaacaaactgtggtgttaattgactgtgtgtgaattccattgtcaattttaatgaaattttctttaaaactctcacctccatctgaacttttcatagtagtgggattgactacaaataaaaacttgtggtattcctggt

SEQ ID NO: 30720 - DNA, 13295 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtttacaggtgtgaaaaaaaaaaaaaaaaaaaaaaaa

SEQ ID NO: 30721 - DNA, 11012 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagcaagaactggaaatacaggaataaatgtttcctaaactactacttgatttcatccttaaaaatcaaaacaaactgtggtgttaattgactgtgtgtgaattccattgtcaattttaatgaaattttctttaaaactctcacctccatctgaacttttcatagtagtgggattgactacaaataaaaacttgtggtattcctggt

SEQ ID NO: 30722 - DNA, 13400 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaaggcacacattcaggggagttcatatatggcttggagaactttgtttacaaggacatcaagcctggacgtaaacgtaaaaagcacaaaaaacattttaagaaaccttttaaaggtcttgatcgttcaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtttacaggtgtg

SEQ ID NO: 30723 - DNA, 5765 bp, Homo sapiens
cagccgcccctcctgcggccgctgcgggggccgccgcctgacttcggacaccggccccgcacccgccaggaggggagggaaggggaggcggggagagcgacggcggggggcgggcggtggaccccgcctcccccggcacagcctgctgaggggaagagggggtctccgctcttcctcagtgcactctctgactgaagcccggcgcgtggggtgcagcgggagtgcgaggggactggacaggtgggaagatgggaatgaggaccgggcggcgggaatgttctcacttctccggattccaccgggatgcaggactctagctgcccagccgcacctgcgaagagactacacttcccgaggtgctcagcggcagcgagggcctccacgcatgcgcaccgcggcgcgctgggcggggctggatgggctgtggtgggagggttgcagcgccgcgagaaaggcgagccgggccgggggcggggaaaggggtggggcaggaacgggggcggggacggcgctggaggggcgggtcgggtaggtctcccggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcgggttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgtacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaacttaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagtttcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattaaaaaaaaaaaaaaaaaaaa

SEQ ID NO: 30724 - DNA, 2450 bp, Homo sapiens
aataggttagtttcagacaagcctgcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgaaaaaaaaaaaaaaaaaaaaa

SEQ ID NO: 30725 - DNA, 1468 bp, Homo sapiens
tgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgaaaaaaaaaaaaaaaaaaaaa

SEQ ID NO: 30726 - DNA, 2466 bp, Homo sapiens
gagtccaaacattcggtggagtcgcggacacttccgctcggggactgaggttgctgcagtttttccgcgatagtttggggcagttccgcgcgttgcaggcccttctgaatttcctggacctacgcattggatcctcaaagaactgctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccacagggatactttccacttcctaagggaagaaaagatttggatgatgaagacagcaatccaaagggaagggaattcaggagacaagatccaaactgagatggagactgtttcagaagcaggaacacatcaagagtggtccttccagcaaatctgggaaaaaattgcaagtgatttaaccaggtctcaagacttggtgataaatagctctcagttctccaaagaaggtgatttcccctgccagactgaggcaggactatctgtaattcacacaagacagaaatcttcccagggcaatggatataaaccatccttcagtgatgtctcccactttgattttcatcaacaattacactcaggagagaaatctcatacgtgtgatgagtgtggaaagaacttttgttacatctcagcccttcgtattcatcagagagtccacatgggagagaaatgctataagtgtgacgtgtgtggtaaggaattcagtcagagttcacatctgcaaactcatcagagagtccacactggagagaaaccgttcaaatgtgtggaatgtgggaaaggcttcagtcgtagatcagcacttaatgttcatcacaaattacacacaggagagaaaccttataattgtgaggaatgcgggaaggccttcattcacgattcccagcttcaagaacatcagagaatccatacgggggagaagccattcaaatgtgatatatgtggtaagagcttctgtggtagatcaagacttaataggcattccatggttcacacggcagagaaaccattccgatgtgatacgtgtgataagagctttcgtcagagatcagcacttaatagtcatcgcatgatccacacaggagagaaaccatacaaatgtgaggagtgtggaaaaggctttatttgtaggcgagatctttatacgcatcatatggtccacacgggagaaaagccatataattgtaaagagtgtgggaagagcttcagatgggcctcgtgtcttttgaaacatcagcgagtccacagtggagaaaaaccattcaaatgtgaagaatgtgggaaaggattttacacaaattcacaatgctattcccaccagagatcccatagtggagaaaaaccatacaaatgtgtggagtgtgggaagggctacaaaaggaggttggatcttgactttcaccagcgcgtccatacaggagagaaactgtataattgtaaggaatgtgggaagagctttagtcgggccccatgtcttttgaaacatgagagactccacagtggagaaaaaccattccaatgtgaagagtgtgggaagagatttactcaaaattcacatcttcattcccatcagagagttcacactggagaaaagccatacaaatgtgagaagtgtggaaagggctacaatagtaagtttaatcttgatatgcaccagaaggtccacacaggagagagaccatacaattgtaaggaatgtgggaagagttttggctgggcctcgtgtcttttgaaacatcagagactgcgcagtggggaaaaacctttcaaatgtgaagagtgtgggaaaagatttactcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctaaagtgcaagaaaaagttcacagtgtagaaaagccatacaaatgtgaggactgtgggaagggctacaacaggcgcttgaatcttgatatgcatcagagggtccacatgggagagaaaacatggaagtgtagggagtgtgatatgtgctttagtcaggcctcaagccttcgacttcatcagaatgttcatgttggagaaaaaccttagtgatgtgatggtgcaataaagtcttcactcagtcttcatg

SEQ ID NO: 30727 - DNA, 2466 bp, Homo sapiens
tccagacactcagtggagtagcgggccacttccgctccgttactgtgaggttgctgcagttttgtccctggtagtttgggtcagttccgcgagacccttctgaatttcctggacctacgcactggatccttaacgaactggtgatcgaattaggggaaaagaaacctcgtcggagagcagaggcaggattctgctttcccttggactgtatcactcaggactctgaatattccctgaaataggaggaaaaatgaccacgttgaaggaggcagtgaccttcaaggacgtggctgtggtcttcactgaggaagagctgaggctgctggaccttgcccagaggaaactgtaccgagaagtgatgctggagaacttcaggaacctgctctcagtggggcatcaatcactccacagagatactttccacttcctaaaggaagaaaagttttggatgatggagacagcaacccaaagagaagggaatttaggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgttaagacagaaacttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatcagcaaattcatcagagaatccacactggagagaaaccattcaaatgtgagcagtgtgggaaaggctttagtcgtagatcaggactttatgttcatcgtaaattacacacaggagtgaaacctcatatttgtgagaaatgtgggaaggccttcattcatgattcccagcttcaggaacatcaaagaatccatactggggagaagccattcaaatgtgatatatgttgtaagagcttccgtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacgcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggaccttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacaccggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaaacatctaaatgtgaggactgtgggaagcgctacaagaggcgcttgaatcttgatacgcttttgtcattatttttaaatgacacataactgttgtactcatttatggggtacagtgtgatagttaatgcaagtatacatgtgtaatgatcaaatcagtgtaattaacatacctatcactcaac

SEQ ID NO: 30728 - DNA, 3962 bp, Homo sapiens
gaattccggcgtcgcggacgcatcccagtctgggcgggacgctcggccgcggcgaggcgggcaagcctggcagggcagagggagccccggctccgaggttgctcttcgcccccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggcttt

SEQ ID NO: 30729 - DNA, 1259 bp, Homo sapiens
gtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaaaaaaaaaaaaaaaaaaa

SEQ ID NO: 30730 - protein, 2045 aa, Homo sapiens
MAGRSHPGPLRPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 30731 - protein, 1023 aa, Homo sapiens
MWDQRLVRLALLQHLRAFYGIKVKGVRGQCDRRRHETAATEIGGKIFGVPFNALPHSAVPEYGHIPSFLVDACTSLEDHIHTEGLFRKSGSVIRLKALKNKVDHGEGCLSSAPPCDIAGLLKQFFRELPEPILPADLHEALLKAQQLGTEEKNKATLLLSCLLADHTVHVLRYFFNFLRNVSLRSSENKMDSSNLAVIFAPNLLQTSEGHEKMSSNTEKKLRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKMRKHPDSVNASLRSTTVYKQKILSDGQVKVPLDDLTNHDIVKPVVNNNMGISSGINNRVLRRPSERGRAWYKGSPKHPIGKTQLLPTSKPVDL

SEQ ID NO: 30732 - protein, 501 aa, Homo sapiens
MWDQRLVRLALLQHLRAFYGIKVKGVRGQCDRRRHETAATEIGGKIFGVPFNALPHSAVPEYGHIPSFLVDACTSLEDHIHTEGLFRKSGSVIRLKALKNKVDHGEGCLSSAPPCDIAGLLKQFFRELPEPILPADLHEALLKAQQLGTEEKNKATLLLSCLLADHTVHVLRYFFNFLRNVSLRSSENKMDSSNLAVIFAPNLLQTSEGHEKMSSNTEKKLRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGTFTYYC

SEQ ID NO: 30733 - protein, 563 aa, Homo sapiens
MRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 30734 - protein, 628 aa, Homo sapiens
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRHRPGKTTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPQAPDPEKLEIDCWAGKPISGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 30735 - protein, 679 aa, Homo sapiens
MGIRGLMSFVEDHSNEFFTDLKLRDTKIVIDGYALFHRLCFSSNLDLRYGGDYDSFADVVQKFFESLFACNICPYVVLDGGCDISDKKLTTLKDRAREKIQMAHSLSVGGSGYVCPLLIREVFIQVLIKLRVCFVQCFSEADRDIMTLANHWNCPVLSSDSDFCIFDLKTGFCPLNSFQWRNMNTIKGTQNYIPAKCFSLDAFCHHFSNMNKALLPLFAVLCGNDHVNLPIMETFLSKARLPLGATSSKGRRHHRILGLLNWLSHFANPTEALDNVLKYLPKKDRENVKELLCCSMEEYQQSQVKLQDFFQCGTYVCPDALNLGLPEWVLVALAKGQLSPFISDALVLRRTILPTQVENMQQPNAHRISQPIRQIIYGLLLNASPHLDKTSWNALPPQPLAFSEVERINKNIRTSIIDAVELAKDHSDLSRLTELSLRRRQMLLLETLKVKQTILEPIPTSLKLPIAVSCYWLQHTETKAKLHHLQSLLLTMLVGPLIAIINSPGKEELQEDGAKMLYAEFQRVKAQTRLGTRLDLDTAHIFCQWQSCLQMGMYLNQLLSTPLPEPDLTRLYSGSLVHGLCQQLLASTSVESLLSICPEAKQLYEYLFNATRSYAPAEIFLPKGRSNSKKKRQKKQNTSCSKNRGRTTAHTKCWYEGNNRFGLLMVENLEEHSEASNIE

SEQ ID NO: 30736 - protein, 823 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 30737 - protein, 894 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGPCRPAQLPAVAPIAASSHPHSSVITSPLRALGALPPCLPLPCCSARPVSGDGTQGEGQTEAPFGCQCQLSGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 30738 - protein, 3418 aa, Homo sapiens
MPIGSKERPTFFEIFKTRCNKADLGPISLNWFEELSSEAPPYNSEPAEESEHKNNNYEPNLFKTPQRKPSYNQLASTPIIFKEQGLTLPLYQSPVKELDKFKLDLGRNVPNSRHKSLRTVKTKMDQADDVSCPLLNSCLSESPVVLQCTHVTPQRDKSVVCGSLFHTPKFVKGRQTPKHISESLGAEVDPDMSWSSSLATPPTLSSTVLIVRNEEASETVFPHDTTANVKSYFSNHDESLKKNDRFIASVTDSENTNQREAASHGFGKTSGNSFKVNSCKDHIGKSMPNVLEDEVYETVVDTSEEDSFSLCFSKCRTKNLQKVRTSKTRKKIFHEANADECEKSKNQVKEKYSFVSEVEPNDTDPLDSNVAHQKPFESGSDKISKEVVPSLACEWSQLTLSGLNGAQMEKIPLLHISSCDQNISEKDLLDTENKRKKDFLTSENSLPRISSLPKSEKPLNEETVVNKRDEEQHLESHTDCILAVKQAISGTSPVASSFQGIKKSIFRIRESPKETFNASFSGHMTDPNFKKETEASESGLEIHTVCSQKEDSLCPNLIDNGSWPATTTQNSVALKNAGLISTLKKKTNKFIYAIHDETFYKGKKIPKDQKSELINCSAQFEANAFEAPLTFANADSGLLHSSVKRSCSQNDSEEPTLSLTSSFGTILRKCSRNETCSNNTVISQDLDYKEAKCNKEKLQLFITPEADSLSCLQEGQCENDPKSKKVSDIKEEVLAAACHPVQHSKVEYSDTDFQSQKSLLYDHENASTLILTPTSKDVLSNLVMISRGKESYKMSDKLKGNNYESDVELTKNIPMEKNQDVCALNENYKNVELLPPEKYMRVASPSRKVQFNQNTNLRVIQKNQEETTSISKITVNPDSEELFSDNENNFVFQVANERNNLALGNTKELHETDLTCVNEPIFKNSTMVLYGDTGDKQATQVSIKKDLVYVLAEENKNSVKQHIKMTLGQDLKSDISLNIDKIPEKNNDYMNKWAGLLGPISNHSFGGSFRTASNKEIKLSEHNIKKSKMFFKDIEEQYPTSLACVEIVNTLALDNQKKLSKPQSINTVSAHLQSSVVVSDCKNSHITPQMLFSKQDFNSNHNLTPSQKAEITELSTILEESGSQFEFTQFRKPSYILQKSTFEVPENQMTILKTTSEECRDADLHVIMNAPSIGQVDSSKQFEGTVEIKRKFAGLLKNDCNKSASGYLTDENEVGFRGFYSAHGTKLNVSTEALQKAVKLFSDIENISEETSAEVHPISLSSSKCHDSVVSMFKIENHNDKTVSEKNNKCQLILQNNIEMTTGTFVEEITENYKRNTENEDNKYTAASRNSHNLEFDGSDSSKNDTVCIHKDETDLLFTDQHNICLKLSGQFMKEGNTQIKEDLSDLTFLEVAKAQEACHGNTSNKEQLTATKTEQNIKDFETSDTFFQTASGKNISVAKESFNKIVNFFDQKPEELHNFSLNSELHSDIRKNKMDILSYEETDIVKHKILKESVPVGTGNQLVTFQGQPERDEKIKEPTLLGFHTASGKKVKIAKESLDKVKNLFDEKEQGTSEITSFSHQWAKTLKYREACKDLELACETIEITAAPKCKEMQNSLNNDKNLVSIETVVPPKLLSDNLCRQTENLKTSKSIFLKVKVHENVEKETAKSPATCYTNQSPYSVIENSALAFYTSCSRKTSVSQTSLLEAKKWLREGIFDGQPERINTADYVGNYLYENNSNSTIAENDKNHLSEKQDTYLSNSSMSNSYSYHSDEVYNDSGYLSKNKLDSGIEPVLKNVEDQKNTSFSKVISNVKDANAYPQTVNEDICVEELVTSSSPCKNKNAAIKLSISNSNNFEVGPPAFRIASGKIVCVSHETIKKVKDIFTDSFSKVIKENNENKSKICQTKIMAGCYEALDDSEDILHNSLDNDECSTHSHKVFADIQSEEILQHNQNMSGLEKVSKISPCDVSLETSDICKCSIGKLHKSVSSANTCGIFSTASGKSVQVSDASLQNARQVFSEIEDSTKQVFSKVLFKSNEHSDQLTREENTAIRTPEHLISQKGFSYNVVNSSAFSGFSTASGKQVSILESSLHKVKGVLEEFDLIRTEHSLHYSPTSRQNVSKILPRVDKRNPEHCVNSEMEKTCSKEFKLSNNLNVEGGSSENNHSIKVSPYLSQFQQDKQQLVLGTKVSLVENIHVLGKEQASPKNVKMEIGKTETFSDVPVKTNIEVCSTYSKDSENYFETEAVEIAKAFMEDDELTDSKLPSHATHSLFTCPENEEMVLSNSRIGKRRGEPLILVGEPSIKRNLLNEFDRIIENQEKSLKASKSTPDGTIKDRRLFMHHVSLEPITCVPFRTTKERQEIQNPNFTAPGQEFLSKSHLYEHLTLEKSSSNLAVSGHPFYQVSATRNEKMRHLITTGRPTKVFVPPFKTKSHFHRVEQCVRNINLEENRQKQNIDGHGSDDSKNKINDNEIHQFNKNNSNQAAAVTFTKCEEEPLDLITSLQNARDIQDMRIKKKQRQRVFPQPGSLYLAKTSTLPRISLKAAVGGQVPSACSHKQLYTYGVSKHCIKINSKNAESFQFHTEDYFGKESLWTGKGIQLADGGWLIPSNDGKAGKEEFYRALCDTPGVDPKLISRIWVYNHYRWIIWKLAAMECAFPKEFANRCLSPERVLLQLKYRYDTEIDRSRRSAIKKIMERDDTAAKTLVLCVSDIISLSANISETSSNKTSSADTQKVAIIELTDGWYAVKAQLDPPLLAVLKNGRLTVGQKIILHGAELVGSPDACTPLEAPESLMLKISANSTRPARWYTKLGFFPDPRPFPLPLSSLFSDGGNVGCVDVIIQRAYPIQWMEKTSSGLYIFRNEREEEKEAAKYVEAQQKRLEALFTKIQEEFEEHEENTTKPYLPSRALTRQQVRALQDGAELYEAVKNAADPAYLEGYFSEEQLRALNNHRQMLNDKKQAQIQLEIRKAMESAEQKEQGLSRDVTTVWKLRIVSYSKKEKDSVILSIWRPSSDLYSLLTEGKRYRIYHLATSKSKSKSERANIQLAATKKTQYQQLPVSDEILFQIYQPREPLHFSKFLDPDFQPSCSEVDLIGFVVSVVKKTGLAPFVYLSDECYNLLAIKFWIDLNEDIIKPHMLIAASNLQWRPESKSGLLTLFAGDFSVFSASPKEGHFQETFNKMKNTVENIDILCNEAENKLMHILHANDPKWSTPTKDCTSGPYTAQIIPGTGNKLLMSSPNCEIYYQSPLSLCMAKRKSVSTPVSAQMTSKSCKGEKEIDDQKNCKKRRALDFLSRLPLPPPVSPICTFVSPAAQKAFQPPRSCGTKYETPIKKKELNSPQMTPFKKFNEISLLESNSIADEELALINTQALLSGSTGEKQFISVSESTRTAPTSSEDYLRLKRRCTTSLIKEQESSQASTEECEKNKQDTITTKKYI

SEQ ID NO: 30739 - protein, 186 aa, Homo sapiens
MSKAQCIVANEAMAPVVNSAVSDCPTLKTKLLVSDKSYDGWLDFKKLIQVAPPKQTYMRTKSQDPMAIFFTKGTTGAPKMVEYSQYGLGMGFSQASRRWMDLQPTDVLWSLGDAFGGSLSLSAVLGTWFQGACVFLCHMPTFCPETVLNVLSRFPITTLSANPEMYQELLQHKCFTRVYSVPLPKQ

SEQ ID NO: 30740 - protein, 351 aa, Homo sapiens
MATDVQLAGYPLMSPKAELKLEKKSGRKPRSPRDSGPQKELVIPGIVDFERIRRALRTPKPQTPGTYCFGRLSHHSFFSRHHPHPQHVTHIQDLTGKPVCVVRDFPAPLPESTVFSGCQMGIPTISVPIGDPQSNRNPQLSSEAWKKELKELASRVAFLTKEDELKKKEKEQKEEPLREQGAKYSAETGRLIPASTRAVGRRRSHQGQQSQSSSRHEGVQAFLLQDQELLVLELLCQILETDLLSAIQFWLLYAPPKEKDLALGLLQTAVAQLLPQPLVSIPTEKLLSQLPEVHEPPQEKQEPPCSQSPKKTKISPFTKSEKPEYIGEAQVLQMHSSQNTEKKTSKPRAES

SEQ ID NO: 30741 - protein, 490 aa, Homo sapiens
MAQRAVWLISHEPGTPLCGTVRFSRRYPTVEKRARVFNGASYVPVPEDGPFLKALLFELRLLDDDKDFVESRDSCSRINKTSIYGLLIGGEELWPVVAFLKNDMIYACVPLVEQTLSPRPPLISVSGVSQGFEFLFGIQDFLYSGQKNDSELNTKLSQLPDLLLQACPFGTLLDANLQNSLDNTNFASVTQPQKQPAWKTGTYKGKPQVSISITEKVKSMQYDKQGIADTWQVVGTVTCKCDLEGIMPNVTISLSLPTNGSPLQDILVHPCVTSLDSAILTSSSIDAMDDSAFSGPYKFPFTPPLESFNLCFYTSQVPAPPILGFYQMKEEEVQLRITINLKLHESVKNNFEFCEAHIPFYNRGPITHLEYKTSFGQLEVFREKSLLIWIIGQKFPKSMEISLSGTVTFGAKSHEKQPFDPICTGETAYLKLHFRILDYTLTGCYADQHSVQVFASGKPKISAHRKLISSDYYIWNSKAPAPVTYGSLLL

SEQ ID NO: 30742 - protein, 1116 aa, Homo sapiens
MESPLIYVSVLLLNIFEFSSGIVYNKDDTEKRFACSNKGFPQENEIIKLYLFLENLKIQCFFQTENEIASKAMLSVFTSGGLAPSLGIMNSTYNGIFHFNLTLFSDRILWLVDIPRENITQSTDIAAVEEWLVRITLHHGLNIYATEGTLLDVIREPILQWTPGDVIPESEISKLYPHVVDLKVTKCPCANDVALLGFIVDTIVDGVYIGITFGGFWHDYDTTWFNMTQTIYSQLQEEYEDLSLVDMVLTNHFLVILTSLGLFVSEDLRYPSRHSLSFSRADFCGFERVDYVKGKLWYNERCFANREHFEVDYVTVTFERNRTLSESSSCFYSQEPFLEWVPCLPHIFKGIKIFPTVLTFLVDQERGTGVYLFYNKVRKTAIASVSTLRNNEPNSQSKFPIFRFPSSFSSPVGMVFHPRSHFLYAYGNQIWLSVDGGNTFQLIANFHDDIIKKTFHSFYTSAITFVSQRGKVYSTKAGMGRYSAVGSVTERIFTLYYDHLGFLHKLTLGRFEASGPPTAFGNSRNLFGQPPDMGFETALAPQHTSLDEIIFFAYVPENEPQETIYSKKFGNIHYGKVIHSGKTGRAYIRKVLQHTTPKGFLSSVIAEMKEPFGLEEVNESSCLSSSLLINKAGNVYKLTLDSQVVQALFEDTDIEKTVVLPGYSSFLITSILDNKNALAIATMPESAPNNMTFLKSTWFLYNFGQRNGRTWKIYSKPCNYWFQHDDSPSLNIVKYIDLGNSYVLKAKVIRNAKGFRMLEIPLLTVFVGNPNLLEVTAEVTFDDTDSYVITISAASKVLHQGSTSLAFIMWSASTECFVTTMVPTLKSSCSYLRSMHHIPSKFIPFEDWISGVHKDSQGFNLIKTLPINYRPPSNMGIAIPLTDNFYHADPSKPIPRNMFHMSKKTGKFKQCANVSTREECNCTKDQKFSHAVAFSDCREKVPRFKFPITQYPVSLEIINEDGRVPLQSPYLVTVTEVNMRHNWKLKHTVPENIKRMKQLVEPILGAAVYNPSGLNLSIKGSELFHFRVTVISGVTFCNLIEEFQIYVDEAPLPFPGHTLIAVATAVVLGGLIFIAFMFQLQGIHPWRTFQRWIRRNQEKFSSISLSELIHRSKSEE

SEQ ID NO: 30743 - protein, 481 aa, Homo sapiens
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDRSTYGLSIILPQTELSFYLPLHRVCVDRLTHIIRKGRIWMHKERQENVQKIILEGTERMEDQGQSIIPMLTGEVIPVMELLSSMKSHSVPEEIDIADTVLNDDDIGDSCHEGFLLNAISSHLQTCGCSVVVGSSAEKVNKIVRTLCLFLTPAERKCSRLCEAESSFKYESGLFVQGLLKDSTGSFVLPFRQVMYAPYPTTHIDVDVNTVKQMPPCHEHIYNQRRYMRSELTAFWRATSEEDMAQDTIIYTDESFTPDLNIFQDVLHRDTLVKAFLDQVFQLKPGLSLRSTFLAQFLLVLHRKALTLIKYIEDDTQKGKKPFKSLRNLKIDLDLTAEGDLNIIMALAEKIKPGLHSFIFGRPFYTSVQERDVLMTF

SEQ ID NO: 30744 - protein, 94 aa, Homo sapiens
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 30745 - protein, 433 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMTVKNKYATSKHAKISTLPQLNSALVQDLAKAVAKV

SEQ ID NO: 30746 - protein, 327 aa, Homo sapiens
MLFLLLPLLAVLPGDGNADGLKEPLSFHVIWIASFYNHSWKQNLVSGWLSDLQTHTWDSNSSTIVFLWPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 30747 - protein, 333 aa, Homo sapiens
MLLLPFQLLAVLFPGGNSEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGEQEQQGTQLGDILPNANWTWYLRATLDVADGEAAGLSCRVKHSSLEGQDIILYWRNPTSIGSIVLAIIVPSLLLLLCLALWYMRRRSYQNIP

SEQ ID NO: 30748 - protein, 333 aa, Homo sapiens
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHSSMNWIALVVIVPLVILIVLVLWFKKHCSYQDIL

SEQ ID NO: 30749 - protein, 335 aa, Homo sapiens
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 30750 - protein, 323 aa, Homo sapiens
MLLLFLLFEGLCCPGENTAAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQR

SEQ ID NO: 30751 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 30752 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 30753 - protein, 250 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 30754 - protein, 235 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 30755 - protein, 198 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAGNRRRVCKCPRPVVKSGDKPSLSARYV

SEQ ID NO: 30756 - protein, 566 aa, Homo sapiens
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 30757 - protein, 1339 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQVKKRGPSFMTSPSPKHLKTDDSTSGLTRSIFKYLES

SEQ ID NO: 30758 - protein, 80 aa, Homo sapiens
MFPLVKSALNRLQVRSIQQTMARQSHQKRTPDFHDKYGNAVLASGATFCIVTWTYVATQVGIEWNLSPVGRVTPKEWRNQ

SEQ ID NO: 30759 - protein, 431 aa, Homo sapiens
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 30760 - protein, 431 aa, Homo sapiens; identical to SEQ ID NO: 30759

SEQ ID NO: 30761 - protein, 431 aa, Homo sapiens; identical to SEQ ID NO: 30759

SEQ ID NO: 30762 - protein, 334 aa, Homo sapiens
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 30763 - protein, 508 aa, Homo sapiens
MDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIRAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRFERDLRRYATHERKMILDNHALYDKTKRIFLKAESEEEIFAHLGLDYIEPWERNA

SEQ ID NO: 30764 - protein, 509 aa, Homo sapiens
MDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIRAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNA

SEQ ID NO: 30765 - protein, 304 aa, Homo sapiens
MLRGSASSTSMEKAKGKEWTSTEKSREEDQQASNQPNSIALPGTSAKRTKEKMSVKGSKVLCPKKKAEHTDNPRPQKKIPIPPLPSKLPPVNLIHRDILRAWCQQLKLSSKGQKLDAYKRLCAFAYPNQKDFPSTAKEAKIRKSLQKKLKVEKGETSLQSSETHPPEVALPPVGEPPALENSTALLEGVNTVVVTTSAPEALLASWARISARARTPEAVESPQEASGVRWCVVHGKSLPADTDGWVHLQFHAGQAWVPEKQEGRVSALFLLPASNFPPPHLEDNMLCPKCVHRNKVLIKSLQWE

SEQ ID NO: 30766 - protein, 782 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 30767 - protein, 169 aa, Homo sapiens
MLPSTMFLVHLPLSTNRLHCLRNTSLESYLCSFVHLNHPLHISDRVILISLHEAVRFSFAFSFPRGTLSIAYCLMSSVSTSSEAIMSTELLANYCHSSLHVCICISSFPNETGNHDSFPGAVVSISDQPTDQCKLAAKELPLRNLLECRFFDCMGEEDLINLGVIGTER

SEQ ID NO: 30768 - protein, 169 aa, Homo sapiens
MLPSTMFLVHLPLSTNRLHCLRNTSLEPCLCSFVHLNHPLHISDPVILISLHEAVRFSFAFSFPRGTLSIAYCLMSSVSTSSEAIMSTELLANYCHSSLHVCICISSFPNETGNHDSFPGAVVSISDQPTDQCKLAAKELPLRNLLECRFFDCMGEEDLINLGVIGTER

SEQ ID NO: 30769 - protein, 734 aa, Homo sapiens
MNSMKTEENKSFSAMEDDQRTRPEVSKDTVMKQTHADTPVDHCLSGIRKCSSTFKLKSEVNKHETALEMQNPNLNNKECCFTFTLNGNSRKLDRSVFTAYGKPSESIYSALSANDYFSERIKNQFNKNIIVYEEKTIDGHINLGMPLKCLPSDSHFKITFGQRKSSKEDGHILRQCENPNMECILFHVVAIGRTRKKIVKINELHEKGSKLCIYALKGETIEGALCKDGRFRSDIGEFEWKLKEGHKKIYGKQSMVDEVSGKVLEMDISKKKALQQKDIHKKIKQNESATDEINHQSLIQSKKKVHKPKKDGETKDVEHSREQILPPQDLSHYIKDKTRQTIPRIRNYYFCSLPRKYRQINSQVRRRPHLGRRYAINLDVQKEAINLLKNYQTLNEAIMHQYPNFKEEAQWVRKYFREEQKRMNLSPAKQFNIYKKDFGKMTANSVSVATCEQLTYYSKSVGFMQWDNNGNTGNATCFVFNGGYIFTCRHVVHLMVGKNTHPSLWPDIISKCAKVTFTYTEFCPTPDNWFSIEPWLKVSNENLDYAILKLKENGNAFPPGLWRQISPQPSTGLIYLIGHPEGQIKKIDGCTVIPLNERLKKYPNDCQDGLVDLYDTTSNVYCMFTQRSFLSEVWNTHTLSYDTCFSDGSSGSPVFNASGKLVALHTFGLFYQRGFNVHALIEFGYSMDSILCDIKKTNESLYKSLNDEKLETYDEEKGKQESSLQDHQIEPMEC

SEQ ID NO: 30770 - protein, 1104 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 30771 - protein, 893 aa, Homo sapiens
MTPPSRAEAGVRRSRVPSEGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 30772 - protein, 267 aa, Homo sapiens
MWDQRLVKLALLQHLRAFYGIKVKGVRGQCDRRRHETAATEIGGKIFGVPFNALPHSAVPEYGHIPSFLVDACTSLEEHIHTEGLFRKSGSVIRLKALKNKVDHGEGCLSSAPPCDIAGLLKQFFRELPEPILPADLHEALLKAQQLGTEEKNKAILLLSCLLADHTVHVLRYFFNFLRNVSLRSSENKMDSSNLAVIFAPNLLQTSEGHEKMSSNAEKKGVYQTLSWKRYQPCWVLMVSVLLHHWKALKKVNMKLLVNIREREDNV

SEQ ID NO: 30773 - protein, 241 aa, Homo sapiens
MWDQRLVKLALLQHLRAFYGIKVKGVRGQCDRRRHETAATEIGGKIFGVPFNALPHSAVPEYGHIPSFLVDACTSLEEHIHTEGLFRKSGSVIRLKALKNKVDHGEGCLSSAPPCDIAGLLKQFFRELPEPILPADLHEALLKAQQLGTEEKNKAILLLSCLLADHTVHVLRYFFNFLRNVSLRSSENKMDSSNLAVIFAPNLLQTSEGHEKMSSNAEKKVRLQAAVVQTLIDYASDIGKM

SEQ ID NO: 30774 - protein, 241 aa, Homo sapiens; identical to SEQ ID NO: 30773

SEQ ID NO: 30775 - protein, 222 aa, Homo sapiens
MWDQRLVKLALLQHLRAFYGIKVKGVRGQCDRRRHETAATEIGGKIFGVPFNALPHSAVPEYGHIPSFLVDACTSLEEHIHTEGLFRKSGSVIRLKALKNKVDHGEGCLSSAPPCDIAGLLKQFFRELPEPILPADLHEALLKAQQLGTEEKNKAILLLSCLLADHTVHVLRYFFNFLRNVSLRSSENKMDSSNLAVIFAPNLLQTSEGHEKMSSNAEKKEL

SEQ ID NO: 30776 - protein, 69 aa, Homo sapiens
MLGIDGLCATPSLEGFEEGEYETPGEYKRKRRQRVGDFVSGALNKFKPNRTPSITPQQERIDNETTTIG

SEQ ID NO: 30777 - protein, 69 aa, Homo sapiens; identical to SEQ ID NO: 30776

SEQ ID NO: 30778 - protein, 69 aa, Homo sapiens; identical to SEQ ID NO: 30776

SEQ ID NO: 30779 - protein, 312 aa, Homo sapiens
MAAGVDCGDGVGARQHVFLVSEYLKDASKKMKNGLMFVKLVNPCSGEGAIYLFNMCLQQLLEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKKIKLSDEPVEAKEDYTKFNTKDLKTEKKNSKMTAAQKALAKVDKSGMKSIDTFFGVKNKKKIGKV

SEQ ID NO: 30780 - protein, 1127 aa, Homo sapiens
MGLGKTVQIIAFLSGMFDASLVNHVLLIMPTNLINTWVKEFIKWTPGMRVKTFHGPSKDERTRNLNRIQQRNGVIITTYQMLINNWQQLSSFRGQEFVWDYVILDEAHKIKTSSTKSAICARAIPASNRLLLTGTPIQNNLQELWSLFDFACQGSLLGTLKTFKMEYENPITRAREKDATPGEKALGFKISENLMAIIKPYFLRRTKEDVQKKKSSNPEARLNEKNPDVDAICEMPSLSRKNDLIIWIRLVPLQEEIYRKFVSLDHIKELLMETRSPLAELGVLKKLCDHPRLLSARACCLLNLGTFSAQDGNEGEDSPDVDHIDQVTDDTLMEESGKMIFLMDLLKRLRDEGHQTLVFSQSRQILNIIERLLKNRHFKTLRIDGTVTHLLEREKRINLFQQNKDYSVFLLTTQVGGVGLTLTAATRVVIFDPSWNPATDAQAVDRVYRIGQKENVVVYRLITCGTVEEKIYRRQVFKDSLIRQTTGEKKNPFRYFSKQELRELFTIEDLQNSVTQLQLQSLHAAQRKSDIKLDEHIAYLQSLGIAGISDHDLMYTCDLSVKEELDVVEESHYIQQRVQKAQFLVEFESQNKEFLMEQQRTRNEGAWLREPVFPSSTKKKCPKLNKPQPQPSPLLSTHHTQEEDISSKMASVVIDDLPKEGEKQDLSSIKVNVTTLQDGKGTGSADSIATLPKGFGSVEELCTNSSLGMEKSFATKNEAVQKETLQEGPKQEALQEDPLESFNYVLSKSTKADIGPNLDQLKDDEILRHCNPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTSKPSALAQETSLGAPEPLSGEQLVGSPQDKAAEATNDYETLVKRGKELKECGKIQEALNCLVKALDIKSADPEVMLLTLSLYKQLNNN

SEQ ID NO: 30781 - protein, 1250 aa, Homo sapiens
MEASRRFPEAEALSPEQAAHYLRYVKEAKEATKNGDLEEAFKLFNLAKDIFPNEKVLSRIQKIQEALEELAEQGDDEFTDVCNSGLLLYRELHNQLFEHQKEGIAFLYSLYRDGRKGGILADDMGLGKTVQIIAFLSGMFDASLVNHVLLIMPTNLINTWVKEFIKWTPGMRVKTFHGPSKDERTRNLNRIQQRNGVIITTYQMLINNWQQLSSFRGQEFVWDYVILDEAHKIKTSSTKSAICARAIPASNRLLLTGTPIQNNLQELWSLFDFACQGSLLGTLKTFKMEYENPITRAREKDATPGEKALGFKISENLMAIIKPYFLRRTKEDVQKKKSSNPEARLNEKNPDVDAICEMPSLSRKNDLIIWIRLVPLQEEIYRKFVSLDHIKELLMETRSPLAELGVLKKLCDHPRLLSARACCLLNLGTFSAQDGNEGEDSPDVDHIDQVTDDTLMEESGKMIFLMDLLKRLRDEGHQTLVFSQSRQILNIIERLLKNRHFKTLRIDGTVTHLLEREKRINLFQQNKDYSVFLLTTQVGGVGLTLTAATRVVIFDPSWNPATDAQAVDRVYRIGQKENVVVYRLITCGTVEEKIYRRQVFKDSLIRQTTGEKKNPFRYFSKQELRELFTIEDLQNSVTQLQLQSLHAAQRKSDIKLDEHIAYLQSLGIAGISDHDLMYTCDLSVKEELDVVEESHYIQQRVQKAQFLVEFESQNKEFLMEQQRTRNEGAWLREPVFPSSTKKKCPKLNKPQPQPSPLLSTHHTQEEDISSKMASVVIDDLPKEGEKQDLSSIKVNVTTLQDGKGTGSADSIATLPKGFGSVEELCTNSSLGMEKSFATKNEAVQKETLQEGPKQEALQEDPLESFNYVLSKSTKADIGPNLDQLKDDEILRHCNPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTSKPSALAQETSLGAPEPLSGEQLVGSPQDKAAEATNDYETLVKRGKELKECGKIQEALNCLVKALDIKSADPEVMLLTLSLYKQLNNN

SEQ ID NO: 30782 - protein, 248 aa, Homo sapiens
MLSTVGSFLQDLQNEDKGIKTAAIFTADGNMISASTLMDILLMNDFKLVINKIAYDVQCPKREKPSNEHTAEMEHMKSLVHRLFTILHLEESQKKREHHLLEKIDHLKEQLQPLEQVKAGIEAHSEAKTSGLLWAGLALLSIQGGALAWLTWWVYSWDIMEPVTYFITFANSMVFFAYFIVTRQDYTYSAVKSRQFLQFFHKKSKQQHFDVQQYNKLKEDLAKAKESLKQARHSLCLQMQVEELNEKN

SEQ ID NO: 30783 - protein, 544 aa, Homo sapiens
MIHVRRHETRRNSKSHVPEQKSRVDWRRTKRSSISQLLDSDEELDSEEFDSDEELDSDESFENDEELDSNKGPDCNKTPGSERELNLSKIQSEGNDSKCLINSGNGSTYEEETNKIKHRNIDLQDQEKHLSQEDNDLNKQTGQIIEDDQEKHLSQEDNDLNKQTGQIIEDDLEEEDIKRGKRKRLSSVMCDSDESDDSDILVRKVGVKRPRRVVEDEGSSVEMEQKTPEKTLAAQKREKLQKLKELSKQRSRQRRSSGRDFEDSEKESCPSSDEVDEEEEEDNYESDEDGDDYIIDDFVVQDEEGDEENKNQQGEKLTTSQLKLVKQNSLYSFSDHYTHFERVVKALLINALDESFLGTLYDGTRQKSYAKDMLTSLHYLDNRFVQPRLESLVSRSRWKEQYKERVENYSNVSIHLKNPENCSCQACGLHRYCKYSVHLSGELYNTRTMQIDNFMSHDKQVFTVGRICASRTRIYHKLKHFKFKLYQECCTIAMTEEVEDEQVKETVERIFRRSKENGWIKEKYGQLEEYLNFADYFQEEKFEL

SEQ ID NO: 30784 - protein, 987 aa, Homo sapiens
MTPALREATAKGISFSSLPSTMESDKMLYMESPRTVDEKLKGDTFSQMLGFPTPEPTLNTNFVNLKHFGSPQSSKHYQTVFLMRSNSTLNKHNENYKQKKLGEPSCNKLKNILYNGSNIQLSKICLSHSEEFIKKEPLSDTTSQCMKDVQIILDSNITKDTNVDKVQLQNCKWYQENALLDKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRSASENLDELSSSSSWLLNQKHSKKKRKDRTRLKSSSLTFMSTSARTRPLQSFHKRKLYRLSPTFYWTPQTLPSKETAFLNTTQMPCLQSASTWSSYEHNSESYLLREHVSELDSSFHSVLSLPSDVPLHFHFETLLKKTEIKGNLAENKFVDEYIISPSPVHSTLNQWRNGYSPICKPQIRSESSAQLLQGRKKRHLSETALGERTKLEESDFQHTESGSHSNFTAVSNVNVLSRIQNSSRNTARRRLRSESSYDIDNIVIPMSLVAPAKLEKLQYKEILTPSWRMVVLQPLDEYNLGKEEIEDLSDEVFSLRHKKYEEREQARWSLWEQSKWHRRNSRAYSKNVEGQDLLLKEYPNNFSSSQQCAAASPPGLPSENQDLCAYGLPSLNQSQETKSLWWERRAFPLKGEDMAALLCQDEKKDQVERSSTAFHGEIFGTSVPENGHHPKKQSDGMEEYKTFGLGLTNVKKNR

SEQ ID NO: 30785 - protein, 193 aa, Homo sapiens
MGMCSRQDRIQKDIDVVIQKSRAEDCLFAGLFKGLKAKGEDGLIQQVLVVRPGECQTLLPARGPMSHPHHDPCPGGAPVRDTGSEDGSGSSSAASKVTGQSGHRLPHWVKEAQRTGRAIPGAHRPFSFPWAPRRFRYVSGPGRFRQLLMKARGKVVLVPESPNLRISNETNTIHHSNLFSFPKPCTVVLSGGL

SEQ ID NO: 30786 - protein, 343 aa, Homo sapiens
MLVVQMPFSFPMAHFILFVFTVSTIFHVQQRLAKIQAMWELPVQIPVLASTSKALGPSQLRGMWTINAIGRLGNQMGEYATLYALAKMNGRPAFIPAQMHSTLAPIFRITLPVLHSATASRIPWQNYHLNDWMEEEYRHFPGEYVRFTGYPCSWTFYHHLRQEILQEFTLHDHVREEAQKFLRGLQVNGSRPGTFVGVHVRRGDYVHVMPKVWKGVVADRRYLQQALDWFRARYSSLIFVVTSNGMAWCRENIDTSHGDVVFAGDGIEGSPAKDFALLTQCNHTIMTIGTFGIWAAYLTGGDTIYLANYTLPDSPFLKIFKPEAAFLPEWTGIAADLSPLLKH

SEQ ID NO: 30787 - protein, 417 aa, Homo sapiens
MAVEELQSIIKRCQILEEQDFKEEDFGLFQLAGQRCIEEGHTDQLLEIIQNEKNKVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFREHVTTNGLQDHS

SEQ ID NO: 30788 - protein, 594 aa, Homo sapiens
MAVEELQSIIKRCQILEEQDFKEEDFGLFQLAGQRCIEEGHTDQLLEIIQNEKNKVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFRCLLNTSNHSGVEAFIIQNIKNQIDMSLKRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 30789 - protein, 157 aa, Homo sapiens
MSGSLGRAAAALLRWGRGAGGGGLWGPGVRAAGSGAGGGGSAEQLDALVKKDKVVVFLKGTPEQPQCGFSNAVVQILRLHGVRDYAAYNVLDDPELRQGIKDYSNWPTIPQVYLNGEFVGGCDILLQMHQNGDLVEELKKLGIHSALLDEKKDQDSK

SEQ ID NO: 30790 - protein, 354 aa, Homo sapiens
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 30791 - protein, 731 aa, Homo sapiens
MVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 30792 - protein, 144 aa, Homo sapiens
MDSEEEEEVPQPMPSIPEDLESQKAMVAFFNSAVASAEEEQARLCGQLKECTASAWLICWPRPRRNLRQQPQPQELGVIPCVGRPTRPCRGPWRSCGRVHRTVPEPEGSAEGGGVHQQAGPGQGRGEGEAAGAGVACGRLQQVA

SEQ ID NO: 30793 - protein, 556 aa, Homo sapiens
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 30794 - protein, 346 aa, Homo sapiens
MYNGSCCRIEGDTISQVMPPLLIVAFVLGALGNGVALCGFCFHMKTWKPSTVYLFNLAVADFLLMICLPFRTDYYLRRRHWAFGDIPCRVGLFTLAMNRAGSIVFLTVVAADRYFKVVHPHHAVNTISTRVAAGIVCTLWALVILGTVYLLLENHLCVQETAVSCESFIMESANGWHDIMFQLEFFMPLGIILFCSFKIVWSLRRRQQLARQARMKKATRFIMVVAIVFITCYLPSVSARLYFLWTVPSSACDPSVHGALHITLSFTYMNSMLDPLVYYFSSPSFPKFYNKLKICSLKPKQPGHSKTQRPEEMPISNLGRRSCISVANSFQSQSDGQWDPHIVEWH

SEQ ID NO: 30795 - protein, 209 aa, Homo sapiens
MKAVVQRVTRASVTVGGEQISAIGRGICVLLGISLEDTQKELEHMVRKILNLRVFEDESGKHWSKSVMDKQYEILCVSQFTLQCVLKGNKPDFHLAMPTEQAEGFYNSFLEQLRKTYRPELIKDGKFGAYMQVHIQNDGPVTIELESPAPGTATSDPKQLSKLEKQQQRKEKTRAKGPSESSKERNTPRKEDRSASSGAEGDVSSEREP

SEQ ID NO: 30796 - protein, 386 aa, Homo sapiens
MGQREMWRLMSRFNAFKRTNTILHHLRMSKHTDAAEEVLLEKKGCTGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 30797 - protein, 338 aa, Homo sapiens
MGQREMWRLMSRFNAFKRTNTILHHLRMSKHTDAAEEVLLEKKGCTGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMF

SEQ ID NO: 30798 - protein, 2406 aa, Homo sapiens
MDPEQSVKGTKKAEGSPRKRLTKGEAIQTSVSSSVPYPGSGTAPTQESPAQELLAPQPFPGPSSVLREGSQEKTGQQQKPPKRPPIEASVHISHVPQHPLTPAFMSPGKPEHLLEGSTWQLVSPMRLGPSGSLLAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSRSSHVFTSHPRMLKPQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKAPPKKKRLRLAEMAQSSGESSFESSVPLSRSPSQESNVSLSGSSRSASFERDDHGKAEAPDPSSDMRPKPLGTHMLTVPSHHPHAREMRRSASEQSPNVSHSAHMTETRSKSFDYGSLSLTGPSAPAPVAPPAGEAPPERRKCFLVRSPSLSRPPESELEVAPKGRQESEEPQPSSSKPSAKSSLSQISSAATSHGGPPGGKGPGQDRPALGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSQEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGQAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGYKSNEEYVYVRGRGRGKYVCEECGIRCKKPSMLKKHIRTHTDVRPYVCKHCHFAFKTKGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGPLPCGSPRLQLSPLTLCPLGRELAPRAHVLSKLEGTTDPGLPRYSPTRRWSPGQAESPPRSAPPGKWALAGPGSPSAGEHGPGLGLAPRVLFPPAPLPHKLLSRSPETCASPWQKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGRDYPKERERTGGGPGRPPDWTPHGTGAPAEPTPTHSPCTPPDTLPRPPQGRRAAQSWSPRLESPRAPANPEPSATPPLDRSSSVGCLAEASARFPARTRNLSGESRTRQDSPKPSGSGEPRAHPHQPEDRVPPNA

SEQ ID NO: 30799 - protein, 1025 aa, Homo sapiens
MSNGYSTDENFRYLISCFRARVKMYIQVEPVLDYLTFLPAEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAEIENLSQVDGPQVEEQLLSTTVQPNLEKEVWGMENNSSESSFADSSVVSESDTSLAEGSVSCLDESLGHNSNMGSDSGTMGSDSDEENVAARASPEPELQLRPYQMEVAQPALEGKNIIICLPTGSGKTRVAVYIAKDHLDKKKKASEPGKVIVLVNKVLLVEQLFRKEFQPFLKKWYRVIGLSGDTQLKISFPEVVKSCDIIISTAQILENSLLNLENGEDAGVQLSDFSLIIIDECHHTNKEAVYNNIMRHYLMQKLKNNRLKKENKPVIPLPQILGLTASPGVGGATKQAKAEEHILKLCANLDAFTIKTVKENLDQLKNQIQEPCKKFAIADATREDPFKEKLLEIMTRIQTYCQMSPMSDFGTQPYEQWAIQMEKKAAKEGNRKERVCAEHLRKYNEALQINDTIRMIDAYTHLETFYNEEKDKKFAVIEDDSDEGGDDEYCDGDEDEDDLKKPLKLDETDRFLMTLFFENNKMLKRLAENPEYENEKLTKLRNTIMEQYTRTEESARGIIFTKTRQSAYALSQWITENEKFAEVGVKAHHLIGAGHSSEFKPMTQNEQKEVISKFRTGKINLLIATTVAEEGLDIKECNIVIRYGLVTNEIAMVQARGRARADESTYVLVAHSGSGVIEHETVNDFREKMMYKAIHCVQNMKPEEYAHKILELQMQSIMEKKMKTKRNIAKHYKNNPSLITFLCKNCSVLACSGEDIHVIEKMHHVNMTPEFKELYIVRENKALQKKCADYQINGEIICKCGQAWGTMMVHKGLDLPCLKIRNFVVVFKNNSTKKQYKKWVELPITFPNLDYSECCLFSDED

SEQ ID NO: 30800 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 30801 - protein, 231 aa, Homo sapiens
MSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 30802 - protein, 177 aa, Homo sapiens
MPVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 30803 - protein, 799 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 30804 - protein, 620 aa, Homo sapiens
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 30805 - protein, 430 aa, Homo sapiens
MSSRSPRPPPRRSRRRLPRPSCCCCCCRRSHLNEDTGRFVLLAALIGLYLVAGATVFSALESPGEAEARARWGATLRNFSAAHGVAEPELRAFLRHYEAALAAGVRADALRPRWDFPGAFYFVGTVVSTIGFGMTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAYRNQGLYRLGNFLFILLGVCCIYSLFNVISILIKQVLNWMLRKLSCRCCARCCPAPGAPLARRNAITPGSRLRRRLAALGADPAARDSDAEGRRLSGELISMRDLTASNKVSLALLQKQLSETANGYPRSVCVNTRQNGFSGGVGALGIMNNRLAETSASR

SEQ ID NO: 30806 - protein, 422 aa, Homo sapiens
MMNPRAKRDFYLAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 30807 - protein, 370 aa, Homo sapiens
MKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 30808 - protein, 411 aa, Homo sapiens
MAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 30809 - protein, 1720 aa, Homo sapiens
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLKHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTLDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 30810 - protein, 571 aa, Homo sapiens
MVSWGGEKRGGAEGSPKPAVYATRKTGSVRSQEDQWYLGYPGDQWSSGFSYSWWKNSVGSESKHGEGALDQPQHDVRLEDLGELHRAARSGDVPGVEHVLVPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEEQDLELTSEEEQERLKGCENKQPQKTSQEPEMAKDCDREDIPIYPVLPHVQKSEEMRIEQGKLEWKNQLKLVINELKQRFGEIYEKYKIPACPEEEPLLDNSTRGTDVKDIPFNLTNNIPGCEEEDASEISVSVVFETFPEQKEPSLKNIIHSYYHPYSGSQEHVCQSSSKLHLHENKLDCDNDNKPGIGHIFSTDKNFHNDASTKKARNPEVVTVEMKEDQEFDLQMTKNMNQNSDSGSTNNYKSLKPKLENLSSLPPDSDRTSEVYLHEELQQDMQKFKNEVNTLEEEFLALKKENVQLHKEVEEEMEKHRSNSTELSGTLTDGTTVGNDDDGLNQQIPRKENGEHDR

SEQ ID NO: 30811 - protein, 226 aa, Homo sapiens
MVSWGGEKRGGAEGSPKPAVYATRKTGSVRSQEDQWYLGYPGDQWSSGFSYSWWKNSVGSESKHGEGALDQPQHDVRLEDLGELHRAARSGDVPGVEHVLVPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEGNKEA

SEQ ID NO: 30812 - protein, 905 aa, Homo sapiens
MDSTACLKSLLLTVSQYKAVKSEANATQLLRHLEVISGQKLTRLFTSNQILTSECLSCLVELLEDPNISASLILSIIGLLSQLAVDIETRDCLQNTYNLNSVLAGVVCRSSHTDSVFLQCIQLLQKLTYNVKIFYSGANIDELITFLIDHIQSSEDELKMPCLGLLANLCRHNLSVQTHIKTLSNVKSFYRTLITLLAHSSLTVVVFALSILSSLTLNEEVGEKLFHARNIHQTFQLIFNILINGDGTLTRKYSVDLLMDLLKNPKIADYLTRYEHFSSCLHQVLGLLNGKDPDSSSKVLELLLAFCSVTQLRHMLTQMMFEQSPPGSATLGSHTKCLEPTVALLRWLSQPLDGSENCSVLALELFKEIFEDVIDAANCSSADRFVTLLLPTILDQLQFTEQNLDEALTRKKCERIAKSIEVLLTLCGDDTLKMHIAKILTTVKCTTLIEQQFTYGKIDLGFGTKVADSELCKLAADVILKTLDLINKLKPLVPGMEVSFYKILQDPRLITPLAFALTSDNREQVQSGLRILLEAAPLPDFPALVLGESIAANNAYRQQETEHIPRKMPWQSSNHSFPTSIKCLTPHLKDGVPGLNIEELIEKLQSGMVVKDQICDVRISDIMDVYEMKLSTLASKESRLQDLLETKALALAQADRLIAQHRCQRTQAETEARTLASMLREVERKNEELSVLLKAQQVESERAQSDIEHLFQHNRKLESVAEEHEILTKSYMELLQRNESTEKKNKDLQITCDSLNKQIETVKKLNESLKEQNEKSIAQLIEKEEQRKEVQNQLVDREHKLANLHQKTKVQEEKIKTLQKEREDKEETIDILRKELSRTEQIRKELSIKASSLEVQKAQLEGRLEEKESLVKLQQEELNKHSHMIAMIHSLSGGKINPETVNLSI

SEQ ID NO: 30813 - protein, 1268 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNICAFLVMGVCEVLIEYNFSISSFSKNRFEDILSLFMCYKKLSDILNEKAGKAKTKMANKTSDSLLSMKFVSSLLTALFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 30814 - protein, 1648 aa, Homo sapiens
MSLHSTHNRNNSGDILDIPSSQNSSSLNALTHSSRLKLHLKSDMSECENDDPLLRSAGKVRDINRTYVISASRKTADMPLTPNPVGRLALQRRTTRNKESSLLVSELEDTTEKTAETRLTLQRRAKTDSAEKWKTAEIDSVKMTLNVGGETENNGVSKESRTNVRIVNNAKNSFVASSVPLDEDPQVIEMMADKKYKETFSAPSRANENVALKYSSNRPPIASLSQTEVVRSGHLTTKPTQSKLDIKVLGTGNLYHRSIGKEIAKTSNKFGSLEKRTPTKCTTEHKLTTKCSLPQLKSPAPSILKNRMSNLQVKQRPKSSFLANKQERSAENTILPEEETVVQNTSAGKDPLKVENSQVTVAVRVRPFTKREKIEKASQVVFMSGKEITVEHPDTKQVYNFIYDVSFWSFDECHPHYASQTTVYEKLAAPLLERAFEGFNTCLFAYGQTGSGKSYTMMGFSEEPGIIPRFCEDLFSQVARKQTQEVSYHIEMSFFEVYNEKIHDLLVCKDENGQRKQPLRVREHPVYGPYVEALSMNIVSSYADIQSWLELGNKQRATAATGMNDKSSRSHSVFTLVMTQTKTEFVEGEEHDHRITSRINLIDLAGSERCSTAHTNGDRLKEGVSINKSLLTLGKVISALSEQANQRSVFIPYRESVLTWLLKESLGGNSKTAMIATISPAASNIEETLSTLRYANQARLIVNIAKVNEDMNAKLIRELKAEIAKLKAAQRNSRNIDPERYRLCRQEITSLRMKLHQQERDMAEMQRVWKEKFEQAEKRKLQETKELQKAGIMFQMDNHLPNLVNLNEDPQLSEMLLYMIKEGTTTVGKYKPNSSHDIQLSGVLIADDHCTIKNFGGTVSIIPVGEAKTYVNGKHILEITVLRHGDRVILGGDHYFRFNHPVEVQKGKRPSGRDTPISEGPKDFEFAKNELLMAQRSQLEAEIKEAQLKAKEEMMQGIQIAKEMAQQELSSQKAAYESKIKALEAELREESQRKKMQEINNQKANHKIEELEKAKQHLEQEIYVNKKRLEMETLATKQALEDHSIRHARILEALETEKQKIAKEVQILQQNRNNRDKTFTVQTTWSSMKLSMMIQEANAISSKLKTYYVFGRHDISDKSSSDTSIRVRNLKLGISTFWSLEKFESKLAAMKELYESNGSNRGEDAFCDPEDEWEPDITDAPVSSLSRRRSRSLMKNRRISGCLHDIQVHPIKNLHSSHSSGLMDKSSTIYSNSAESFLPGICKELIGSSLDFFGQSYDEERTIADSLINSFLKIYNGLFAISKAHEEQDEESQDNLFSSDRAIQSLTIQTACAFEQLVVLMKHWLSDLLPCTNIARLEDELRQEVKKLGGYLQLFLQGCCLDISSMIKEAQKNAIQIVQQAVKYVGQLAVLKGSKLHFLENGNNKAASVQEEFMDAVCDGVGLGMKILLDSGLEKAKELQHELFRQCTKNEVTKEMKTNAMGLIRSLENIFAESKIKSFRRQVQEENFEYQDFKRMVNRAPEFLKLKHCLEKAIEIIISALKGCHSDINLLQTCVESIRNLASDFYSDFSVPSTSVGSYESRVTHIVHQELESLAKSLLFCFESEESPDLLKPWETYNQNTKEEHQQSKSSGIDGSKNKGVPKRVYELHGSSPAVSSEECTPSRIQWV

SEQ ID NO: 30815 - protein, 288 aa, Homo sapiens
MAAAAYVDHFAAECLVSMSSRAVVHGPREGPESRPEGAAVAATPTLPRVEERRDGKDSASLFVVARILADLNQQAPAPAPAERREGAAARKARTPCRLPPPAPEPTSPGAEGAAAAPPSPAWSEPEPEAGLEPEREPGPAGSGEPGLRQRVRRGRSRADLESPQRKHKCHYAGCEKVYGKSSHLKAHLRTHTGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 30816 - protein, 642 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVEKHLEEQIAKVDREYEECMSEDLSENIKEIRDKYEKKATLIKSSEE

SEQ ID NO: 30817 - protein, 404 aa, Homo sapiens
MPYNFCLPSLSCRTSCSSRPCVPPSCHGYTLPGACNIPANVSNCNWFCEGSFNGSEKETMQFLNDRLASYLEKVRQLERDNAELENLIRERSQQQEPLLCPSYQSYFKTIEELQQKILCSKSENARLVVQIDNAKLAADDFRTKYQTEQSLRQLVESDINSLRRILDELTLCRSDLEAQMESLKEELLSLKQNHEQEVNTLRCQLGDRLNVEVDAAPAVDLNQVLNETRNQYEALVETNRREVEQWFATQTEELNKQVVSSSEQLQSYQAEIIELRRTVNALEIELQAQHNLRYSLENTLTESEARYSSQLSQVQSLITNVESQLAEIRSDLERQNQEYQVLLDVRARLECEINTYRSLLESEDCKLPSNPCATTNACEKPIGSCVTNPCGPRSRCGPCNTFGY

SEQ ID NO: 30818 - protein, 1816 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 30819 - protein, 615 aa, Homo sapiens
MPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFSLSQESSYIATQYSLRPRREEVKLKEIDSKEEKYVAKELAVRTFEVTPIRAKDLEFGGVPGVFLIMFGLPVFLFLLLLMCKQKDPSLLNFPPPLPALYELWETRVFGVYLLWFLIQVLFYLLPIGKVVEGTPLIDGRRLKYRLNGFYAFILTSAVIGTSLFQGVEFHYVYSHFLQFALAATVFCVVLSVYLYMRSLKAPRNDLSPASSGNAVYDFFIGRELNPRIGTFDLKYFCELRPGLIGWVVINLVMLLAEMKIQDRAVPSLAMILVNSFQLLYVVDALWNEEALLTTMDIIHDGFGFMLAFGDLVWVPFIYSFQAFYLVSHPNEVSWPMASLIIVLKLCGYVIFRGANSQKNAFRKNPSDPKLAHLKTIHTSTGKNLLVSGWWGFVRHPNYLGDLIMALAWSLPCGFNHILPYFYIIYFTMLLVHREARDEYHCKKKYGVAWEKYCQRVPYRIFPYIY

SEQ ID NO: 30820 - protein, 615 aa, Homo sapiens; identical to SEQ ID NO: 30819

SEQ ID NO: 30821 - protein, 509 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEPLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 30822 - protein, 572 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 30823 - protein, 664 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 30824 - protein, 634 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 30825 - protein, 1025 aa, Homo sapiens
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 30826 - protein, 1011 aa, Homo sapiens
MIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 30827 - protein, 103 aa, Homo sapiens
MPGPPESLDMGPLTFRDVAIEFSLEEWQCLDTAQQDLYRKVMLENYRNLVFLAGIAVSKPDLVTCLEQGKDPWNMKGHSTVVKPPVETGFHRFGQDGLYLLTS

SEQ ID NO: 30828 - protein, 492 aa, Homo sapiens
MPSFLVPSLVSSPVLLKLLFSPGPKTIWSLWQQPMLFQEATAFENMTKDWNYLEGSQKDCYRDTMLDSYENTVPQGSFLQLSMMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNELWPDLKIVSGKYHPGQSQGSLEGASRDVKNMISTWMQSNHSCHWAKGLRFMQMVRNQAFDVSLQQSPFEAMFGYKAKFGLYSSNLPRETVATLQTEEELEIAEEQLENSLWIRQEERAEIGADRSDMDDDMDPTPEASEPSTSQGTSGLLCW

SEQ ID NO: 30829 - protein, 354 aa, Homo sapiens
MRYTTVPSVRPTALATKKLDLWRLPPFLIIHLKRFQFVNDQWIKSQKIVKFPRESFDPSAFLVPRDPALCQHQPLTPQGDELSKPRILAREVKKVDVQSLAGEEDMLLSKSPSSLSANISSSPKGSPSSSRKSGTSCPSSKNSSPNSCPRTLGRSKGRLRLPQIGSKNKLSSSKKNLDASKENGAEQICELADALSRGHMRGGSQPELVTPQDHEVALGNGFLYEHEAYGNGYSNGQLGNHSEEDSTDDQREDTHIKPIYNLYAISCHSGILSGGHYVTYAKNPNCKWYCYNGSICEEHHPDEIDTDSAYILFYEQQRIDYAQFLPKIDGKKMADTSSMDEDFESDYEKYCVLQ

SEQ ID NO: 30830 - protein, 263 aa, Homo sapiens
MFCCLGYEWLSGGCKTWHSAWVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVSLLVFLAFGHSLPGQDMDTFFSLQLCAQALQREMAERKAAYKHHSPIPVGNRVAQKHLHPHPVGPLI

SEQ ID NO: 30831 - protein, 263 aa, Homo sapiens; identical to SEQ ID NO: 30830

SEQ ID NO: 30832 - protein, 175 aa, Homo sapiens
MFCCLGYEWLSGGCKTWHSAWVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQINHILQKDYACL

SEQ ID NO: 30833 - protein, 163 aa, Homo sapiens
MFCCLGYEWLSGGCKTWHSAWVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQ

SEQ ID NO: 30834 - protein, 447 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDKLKTPPECLLTPLPPSALPSAPPSADDNLKTRAECLLHPLPPSADDNLKTPSERQLTPLPPSAPPSADDNIKTPAERLRGPLPPSADDNLKTPSEPSAHSPSTLSSTLSR

SEQ ID NO: 30835 - protein, 70 aa, Homo sapiens
MTKSMERGRPPENRKCFNVRKSCGGEQRTTTNAKSPLLQERLFATGSEWRQRSIVILQDCPTGPTSQLKL

SEQ ID NO: 30836 - protein, 47 aa, Homo sapiens
MTKSMERGRPPENNPPFCKKGSLQLGQNGGSGASSFFRIALLALPHS

SEQ ID NO: 30837 - protein, 739 aa, Homo sapiens
MFCCLGYEWLSGGCKTWHSAWVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDKLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 30838 - protein, 789 aa, Homo sapiens
MFCCLGYEWLSGGCKTWHSAWVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDKLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPIPAERLRIPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPHSAPPSADDNIKTPAERLRGASAGAASTLSG

SEQ ID NO: 30839 - protein, 1042 aa, Homo sapiens
MQMMPRPLDSLNIQFLMCWLFQIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDKLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAFHPQRMIISRHLPSVSSLPFHPQLHPQQMIISRYLLSVCGFRFHHQPMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHTQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 30840 - protein, 193 aa, Homo sapiens
MFCCLGYEWLSGGCKTWHSAWVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKVRSFLPAVAG

SEQ ID NO: 30841 - protein, 70 aa, Homo sapiens; identical to SEQ ID NO: 30835

SEQ ID NO: 30842 - protein, 1006 aa, Homo sapiens; identical to SEQ ID NO: 22272

SEQ ID NO: 30843 - protein, 263 aa, Homo sapiens; identical to SEQ ID NO: 30830

SEQ ID NO: 30844 - protein, 282 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVSLLVFLAFGHSLPGQDMDTFFSLQLCAQALQREMAERKAAYKHHSPIPVGNRVAQKHLHPHPVGPLI

SEQ ID NO: 30845 - protein, 263 aa, Homo sapiens; identical to SEQ ID NO: 30830

SEQ ID NO: 30846 - protein, 1006 aa, Homo sapiens; identical to SEQ ID NO: 22272

SEQ ID NO: 30847 - protein, 263 aa, Homo sapiens; identical to SEQ ID NO: 30830

SEQ ID NO: 30848 - protein, 263 aa, Homo sapiens; identical to SEQ ID NO: 30830

SEQ ID NO: 30849 - protein, 1006 aa, Homo sapiens; identical to SEQ ID NO: 22272

SEQ ID NO: 30850 - protein, 238 aa, Homo sapiens
MFCCLGYEWLSGGCKTWHSAWVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWLCAQALQREMAERKAAYKHHSPIPVGNRVAQKHLHPHPVGPLI

SEQ ID NO: 30851 - protein, 282 aa, Homo sapiens; identical to SEQ ID NO: 30844

SEQ ID NO: 30852 - protein, 263 aa, Homo sapiens; identical to SEQ ID NO: 30830

SEQ ID NO: 30853 - protein, 154 aa, Homo sapiens
MSATRAKKVKMATKSCPECDQQVPVACKSCPCGYIFISRKLLNAKHSEKSPPSTENKHEAKRRRTERVRREKINSTVNKDLENRKRSRSNSHSDHIRRGRGRPKSASAKKHEEEREKQEKEIDIYANLSDEKAFVFSVALAEINRKIINQRLIL

SEQ ID NO: 30854 - protein, 326 aa, Homo sapiens
MHICKALHPRMVLPCPGFCGTSVIPNQRSGGQRSGQSPTGSTLGAARSDFQSCSKQRISKSAEATDSFGWGEVLLLWDCLCRVGLESERWREWNKASSRVPRSPGAPPRRWRRGGDTGRRPAAATSRVWRVWGPGSPARAAVEPRATRALPSARAGTGRIRSCGEEPGAAPGGSASRVGGHGPAEGQTTEAAKLEERDRGIDRGWLARGGTGRATDRWEQSDSLREGDQNAKRARALSRQGEAHRKIDSNTRVLPPSTRPPLTERSGQGHRVGEDCGHRRPEEGRCIAGGTEGFGRTDRPAHRLAACESGSFESRAQQSENPAPSC

SEQ ID NO: 30855 - protein, 101 aa, Homo sapiens
MRTPKRTRSPKTKVSLRGETLTLQLTTVSLDTRHMVKRCDERHGRPLPHSQESQHGSATSKKAVRGTADTAPLERISAARGWALPMEATVSVFRAHQWQWN

SEQ ID NO: 30856 - protein, 22 aa, Homo sapiens
MGTSISLCSCKKLAAEPTCESL

SEQ ID NO: 30857 - protein, 142 aa, Homo sapiens [sequence omitted]

SEQ ID NO: 30858 - protein, 142 aa, Homo sapiens [sequence omitted]

SEQ ID NO: 30859 - protein, 120 aa, Homo sapiens
MNTNSYRGSYHFRAPSRIFWRTVRGMLPHKTKRGQAALDRLKVVRLKPTRKFAYLGRLAHEFGWKYQAGTATLEEKRKEKAKIHYGKKKQLMRLRKQAEKNVEKKIDKYTEVLKTHGLLI

SEQ ID NO: 30860 - protein, 142 aa, Homo sapiens [sequence omitted]

SEQ ID NO: 30861 - protein, 303 aa, Homo sapiens [sequence omitted]

SEQ ID NO: 30862 - protein, 303 aa, Homo sapiens [sequence omitted]

SEQ ID NO: 30863 - protein, 186 aa, Homo sapiens [sequence omitted]

SEQ ID NO: 30864 - protein, 186 aa, Homo sapiens [sequence omitted]

SEQ ID NO: 30865 - protein, 142 aa, Homo sapiens [sequence omitted]

SEQ ID NO: 30866 - protein, 38 aa, Homo sapiens [sequence omitted]

SEQ ID NO: 30867 - protein, 89 aa, Homo sapiens
MSMQRLAPKKTRKEQSANDHPIGGPEGRLFTSQLQLKFRALSERNSWLEVSRAVTPTSAAVTSTPSTSKPRQKRPTNSQSRSAAKPTPV

SEQ ID NO: 30868 - protein, 104 aa, Homo sapiens
MSMQRLAPKKTRKEQSANDHPIGGPEGRLFTSQLQLKFRALSERNSWLEVSRAVTPTSAAVTSTPSTSKPRQKRPTNSQSRSAAKPTPVVFLQKIINCGEEEGK

SEQ ID NO: 30869 - protein, 38 aa, Homo sapiens [sequence omitted]

SEQ ID NO: 30870 - protein, 142 aa, Homo sapiens [sequence omitted]

SEQ ID NO: 30871 - protein, 120 aa, Homo sapiens; identical to SEQ ID NO: 30859

SEQ ID NO: 30872 - protein, 142 aa, Homo sapiens [sequence omitted]

SEQ ID NO: 30873 - protein, 142 aa, Homo sapiens [sequence omitted]

SEQ ID NO: 30874 - protein, 142 aa, Homo sapiens [sequence omitted]

SEQ ID NO: 30875 - protein, 123 aa, Homo sapiens [sequence omitted]

SEQ ID NO: 30876 - protein, 291 aa, Homo sapiens
MELFNSTYWISLQLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKVCEKL

SEQ ID NO: 30877 - protein, 115 aa, Homo sapiens [sequence omitted]

SEQ ID NO: 30878 - protein, 89 aa, Homo sapiens; identical to SEQ ID NO: 30867

SEQ ID NO: 30879 - protein, 104 aa, Homo sapiens; identical to SEQ ID NO: 30868

SEQ ID NO: 30880 - protein, 82 aa, Homo sapiens
MASPSGSSKATGKPRGWDGRPRREEDDVPPEEKRLRLGLEGGSAQPEDCEDGEDAPRPGREETGTQTGGDGRGMESFSVTQA

SEQ ID NO: 30881 - protein, 561 aa, Homo sapiens [sequence omitted]

SEQ ID NO: 30882 - protein, 218 aa, Homo sapiens
MKGLRVAKAFQPSQGCSRQALGHLSGRGPSPRSEMNSSVGDLGVGGCSLWDDPARFIVVPAAYALALGLGLPANVAALAMFIRSGGRLGQALLLYLFNLALVDEFFTLTLQLWLTYYLGLARRPPATRPGPPTTCPPMRRWSSPRSSACAAAASYAVPGPGRLPAWPGAYGAPRALPAPSPGWRAWPLPAWSTAGQARGWPPPRWPSRPPSCWCSRPT

SEQ ID NO: 30883 - protein, 218 aa, Homo sapiens; identical to SEQ ID NO: 30882

SEQ ID NO: 30884 - protein, 926 aa, Homo sapiens
MHFRDTSERQSDAVNESSLDSVHLQMIKGMLYQQRQDFSSQDSVSRKKVLSLNLKQTSKTEEIKNVLGGSTCYNYSVKDLQEISGSELCFPSGQKIKSAYLPQRQIHIPAVFQSPAHYKQTFTSCLIEHLNILLFGLAQNLQKALSKVDISFYTSLKGEKLKNAENNVPSCHHSQPAKLVMVKKEGPNKGRLFYTCDGPKADRCKFFKWLEDVTPGYSTQEGARPGMVLSDIKSIGLYLRSQKIPLYEECQLLVRKGFDFQRKQYGKLKKFTTVNPEFYNEPKTKLYLKLSRKERSSAYSKNDLWVVSKTLDFELDTFIACSAFFGPSSINEIEILPLKGYFPSNWPTNMVVHALLVCNASTELTTLKNIQDYFNPATLPLTQYLLTTSSPTIVSNKRVSKRKFIPPAFTNVSTKFELLSLGATLKLASELIQVHKLNKDQATALIQIAQMMASHESIEEVKELQTHTFPITIIHGVFGAGKSYLLAVVILFFVQLFEKSEAPTIGNARPWKLLISSSTNVAVDRVLLGLLSLGFENFIRVGSVRKIAKPILPYSLHAGSENESEQLKELHALMKEDLTPTERVYVRKSIEQHKLGTNRTLLKQVRVVGVTCAACPFPCMNDLKFPVVVLDECSQITEPASLLPIARFECEKLILVGDPKQLPPTIQGSDAAHENGLEQTLFDRLCLMGHKPILLRTQYRCHPAISAIANDLFYKGALMNGVTEIERSPLLEWLPTLCFYNVKGLEQIERDNSFHNVAEATFTLKLIQSLIASGIAGSMIGVITLYKSQMYKLCHLLSAVDFHHPDIKTVQVSTVDAFQGAEKEIIILSCVRTRQVGFIDSEKRMNVALTRGKRHLLIVGNLACLRKNQLWGRVIQHCEGREDGLQHANQYEPQLNHLLKDYFEKQVEEKQKKKSEKEKSKDKSHS

SEQ ID NO: 30885 - protein, 31 aa, Homo sapiens
MAKKKEKKECHQKQGALREQLQESEDLASRL

SEQ ID NO: 30886 - protein, 31 aa, Homo sapiens; identical to SEQ ID NO: 30885

SEQ ID NO: 30887 - protein, 1403 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 30888 - protein, 325 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYK

SEQ ID NO: 30889 - protein, 371 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 30890 - protein, 1722 aa, Homo sapiens
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNNSLMWFDKTPLSYTHWRAGRPTIKNEKFLAGLSTDGFWDIQTFKVIEEAVYFHQHSILACKIEMVDYKEEHNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPDYTAIAIIVATLSILVLMGGLIWFLFQRHRLHLAGFSSVRYAQGVNEDEIMLPSFHD

SEQ ID NO: 30891 - protein, 317 aa, Homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSTVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 30892 - protein, 146 aa, Homo sapiens
MTMRSLLRTPFLCGLLWAFCAPGARAEEPAASFSQPGSMGLDKNTVHDQEHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 30893 - protein, 478 aa, Homo sapiens
MAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 30894 - protein, 50 aa, Homo sapiens
MAVTGAGSGARLSLPRGSSDSTRVAARPWQRPSSRGWELHRVPPRPGEDA

SEQ ID NO: 30895 - protein, 50 aa, Homo sapiens; identical to SEQ ID NO: 30894

SEQ ID NO: 30896 - protein, 282 aa, Homo sapiens
MGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPGFLFVLLGVGSMGVAAIVWGAWFWGRRSCQQRDSGNSPGNAFYSNVLYRPRGPPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 30897 - protein, 205 aa, Homo sapiens
MSKKKGLSAEEKRTRMMEIFSETKDVFQLKDLEKIAPKEKGITAMSVKEVLQSLVDDGMVDCERIGTSNYYWAFPSKALHARKHKLEVLESQLSEGSQKHASLQKSIEKAKIGRCETEERTRLAKELSSLRDQREQLKAEVEKYKDCDPQVVEEIRQANKVAKEAANRWTDNIFAIKSWAKRKFGFEENKIDRTFGIPEDFDYID

SEQ ID NO: 30898 - protein, 332 aa, Homo sapiens
MASGLVRLLQQGHRCLLAPVAPKLVPPVRGVKKGFRAAFRFQKELERQRLLRCPPPPVRRSEKPNWDYHAEIQAFGHRLQENFSLDLLKTAFVNSCYIKSEEAKRQQLGIEKEAVLLNLKSNQELSEQGTSFSQTCLTQFLEDEYPDMPTEGIKNLVDFLTGEEVVCHVARNLAVEQLTLSEEFPVPPAVLQQTFFAVIGALLQSSGPERTALFIRDFLITQMTGKELFEMWKIINPMGLLVEELKKRNVSAPESRLTRQSGGTTALPLYFVGLYCDKKLIAEGPGETVLVAEEEAARVALRKLYGFTENRRPWNYSKPKETLRAEKSITAS

SEQ ID NO: 30899 - protein, 515 aa, Homo sapiens
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAECKMLLNS

SEQ ID NO: 30900 - protein, 640 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 30901 - protein, 151 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 30902 - protein, 151 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 30903 - protein, 169 aa, Homo sapiens
MICLVLTIFANLFPAACTGAHERTFLAVKPDGVQRRLVGEIVRRFERKGFKLVALKLVQASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 30904 - protein, 420 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 30905 - protein, 323 aa, Homo sapiens
MGMEGLLQNSTNFVLTGLITHPAFPGLLFAVVFSIFVVAITANLVMILLIHMDSRLHTPMYFLLSQLSIMDTIYICITVPKMLQDLLSKDKTISFLGCAVQIFYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 30906 - protein, 334 aa, Homo sapiens
MEPGPTAAQRRCSLPPWLPLGLLLWSGLALGALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNTSESQSCARSLLMADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDAMNITRKLWSRTFNCSVPCSDTVPVIAVSVFILFLPVVFYLSSFLHSEQKKRKLILPKRLKSSTSFANIQENSN

SEQ ID NO: 30907 - protein, 465 aa, Homo sapiens
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQGPSCWDDVLIPNRMSGECQSPHCPGTSAEFFFKCGAHPTSDKETPVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 30908 - protein, 437 aa, Homo sapiens
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQEFFFKCGAHPTSDKETPVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 30909 - protein, 316 aa, Homo sapiens
MIVFVRFNSSHGFPVEVDSDTSIFQLKEVVAKRQGVPADQLRVIFAGKELRNDWTVQEFFFKCGAHPTSDKETPVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 30910 - protein, 344 aa, Homo sapiens
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 30911 - protein, 1132 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGCLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQL

SEQ ID NO: 30912 - protein, 133 aa, Homo sapiens
MLSPEAERVLRYLVEVEELAEEVLADKRQIVDLDTKRNQNREGLRALQKDLSLSEDVMVCFGNMFIKMPHPETKEMIEKDQDHLDKEIEKLRKQLKVKVNRLFEAQGKPELKGFNLNPLNQDELKALKVILKG

SEQ ID NO: 30913 - protein, 323 aa, Homo sapiens
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEVYSVDWSQTRGEQLVVSGSWDQTVKLWDPTVGKSLCTFRGHESIIYSTIWSPHIPGCFASASGDQTLRIWDVKAAGVRIVIPAHQAEILSCDWCKYNENLLVTGAVDCSLRGWDLRNVRQPVFELLGHTYAIRRVKFSPFHASVLASCSYDFTVRFWNFSKPDSLLETVEHHTEFTCGLDFSLQSPTQVADCSWDETIKIYDPACLTIPA

SEQ ID NO: 30914 - protein, 612 aa, Homo sapiens
MAAPEGSGLGEDARLDQETAQWLRWDKNSLTLEAVKRLIAEGNKEELRKCFGARMEFGTAGLRAAMGPGISRMNDLTIIQTTQGFCRYLEKQFSDLKQKGIVISFDARAHPSSGGSSRRFARLAATTFISQGIPVYLFSDITPTPFVPFTVSHLKLCAGIMITASHNPKQDNGYKVYWDNGAQIISPHDKGISQAIEENLEPWPQAWDDSLIDSSPLLHNPSASINNDYFEDLKKYCFHRSVNRETKVKFVHTSVHGVGHSFVQSAFKAFDLVPPEAVPEQKDPDPEFPTVKYPNPEEGKGVLTLSFALADKTKARIVLANDPDADRLAVAEKQDSGEWRVFSGNELGALLGWWLFTSWKEKNQDRSALKDTYMLSSTVSSKILRAIALKEGFHFEETLTGFKWMGNRAKQLIDQGKTVLFAFEEAIGYMCCPFVLDKDGVSAAVISAELASFLATKNLSLSQQLKAIYVEYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELVSAIEEHFFQPQKYNLQPKAD

SEQ ID NO: 30915 - protein, 1093 aa, Homo sapiens
MAGAAGLTAEVSWKVLERRARTKRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWLAVRYGAAFTQKFSSSIAPHITTFLVHGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 30916 - protein, 1086 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 30917 - protein, 188 aa, Homo sapiens
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQSAKPRLDCLIEVYRSCQEILAHQKATSTSP

SEQ ID NO: 30918 - protein, 1385 aa, Homo sapiens
MELSDSDRPVSFGSTSSSASSRDSHGSFGSRMTLVSNSHMGLFNQDKEVGAIKLELIPARPFSSSELQRDNPATGQQNADEGSERPPRAQWRVDSNGAPKTIADSATSPKLLYVDRVVQEILETERTYVQDLKSIVEDYLDCIRDQTKLPLGTEERSALFGNIQDIYHFNSELLQDLENCENDPVAIAECFVSKSEEFHIYTQYCTNYPRSVAVLTECMRNKILAKFFRERQETLKHSLPLGSYLLKPVQRILKYHLLLHEIENHLDKDTEGYDVVLDAIDTMQRVAWHINDMKRKHEHAVRLQEIQSLLTNWKGPDLTSYGELVLEGTFRIQRAKNERTLFLFDKLLLITKKRDDTFTYKAHILCGNLMLVEVIPKEPLSFSVFHYKNPKLQHTVQAKSQQDKRLWVLHLKRLILENHAAKIPAKAKQAILEMDAIHHPGFCYSPEGGTKALFGSKEGSAPYRLRRKSEPSSRSHKVLKTSETAQDIQKVSREEGSPQLSSARPSPAQRNSQPSSSTMISVLRAGGALRNIWTDHQIRQALFPSRRSPQENEDDEDDYQMFVPSFSSSDLNSTRLCEDSTSSRPCSWHMGQMESTETSSSGHRIVRRASSAGESNTCPPEIGTSDRTRELQNSPKTEGQEEMTPFGSSIELTIDDIDHVYDNISYEDLKLMVAKREEAESTPSKSARDSVRPKSTPELAFTKRQAGHSKGSLYAQTDGTLSGGEASSQSTHELQAVEENIYDTIGLPDPPSLGFKCSSLKRAKRSTFLGLEADFVCCDSLRPFVSQDSLQLSEDEAPYHQATPDHGYLSLLYDSPSGNLSMPHKPVSDKLSEEVDEIWNDLENYIKKNEDKARDRLLAAFPVSKDDVPDRLHAESTPELSRDVGRSVSTLSLPESQALLTPVKSRAGRASRANCPFEEDLISKEGSFMSLNRLSLASEMPLMDNPYDLANSGLSQTDPENPDLGMEATDKTKSRVFMMARQYSQKIKKANQLLKVKSLELEQPPASQHQKSMHKDLAAILEEKKQGGPAIGARIAEYSQLYDQIVFRESPLKIQKDGWASPQESSLLRSVSPSQVHHGSGDWLLHSTYSNGELADFCLPPEQDLRSRYPTFEINTKSTPRQLSAACSVPSLQTSDPLPGSVQRCSVVVSQPNKENWCQDHLYNSLGRKGISAKSQPYHRSQSSSSVLINKSMDSINYPSDVGKQQLLSLHRSSRCESHQDLLPDIADSHQQGTEKLSDLTLQDSQKVVVVNRNLPLNAQIATQNYFSNFKETDGDEDDYVEIKSEEDESELELSHNRRRKSDSKFVDADFSDNVCSGNTLHSLNSPRTPKKPVNSKLGLSPYLTPYNDSDKLNDYLWRGPSPNQQNIVQSLREKFQCLSSSSFA

SEQ ID NO: 30919 - protein, 932 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 30920 - protein, 550 aa, Homo sapiens
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 30921 - protein, 565 aa, Homo sapiens
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRKSDVPGVVKTGSTKELDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 30922 - protein, 514 aa, Homo sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVVSRSLMSTAIGGSLECRAAVSVAFAEVERRLRSGGAAQAALRTELSACGPLGRAENQAELLGALQALVGGVVQYDGQTGAPLSVRQLCGLLLGGGGNRSHSTPYCGLRRAVQIVLHSLGQKCLSFSRAETVAQLRSTEPQLSGVGDRQWLYQTCTEFGFYVTCENPRCPFSQLPALPSQLDLCEQVFGLSALSVAQAVAQTNSYYGGQTPGANKVLFVNGDTDPWHVLSVTQALGSSESTLLIRTGSHCLDMAPERPSDSPSLRLGRQNIFQQLQTWLKLAKESQIKGEV

SEQ ID NO: 30923 - protein, 281 aa, Homo sapiens
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSRLRAPSSSLGAFFRGDLPPPLQAGAA

SEQ ID NO: 30924 - protein, 232 aa, Homo sapiens
MGPLALPAWLQPRYRKNAYLFIYYLIQFCGHSWIFTNMTVRFFSFGNDSMVDTFYAIGLVMRLCQSVSLLELLHIYVGIESNHLLPRFLQLTERIIILFVVITSQEEVQEKYVVCVLFVFWNLLDMVRYTYSMLSVIGISYAVLTWLSQTLWMPIYPLCVLAEAFAIYQSLPYFESFGTYSTKLPFDLSIYFPYVLKIYLMMLFIGMYFTYSHLYSERRDILGIFPIKKKKM

SEQ ID NO: 30925 - protein, 360 aa, Homo sapiens
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 30926 - protein, 399 aa, Homo sapiens
MGASFWPIRQAREQQRRALSFRQTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 30927 - protein, 360 aa, Homo sapiens; identical to SEQ ID NO: 30925

SEQ ID NO: 30928 - protein, 1043 aa, Homo sapiens
MAASFPPTLGLSSAPDEIQHPHIKFSEWKFKLFRVRSFEKTPEEAQKEKKDSFEGKPSLEQSPAVLDKADGQKPVPTQPLLKAHPKFSKKFHDNEKARGKAIHQANLRHLCRICGNSFRADEHNRRYPVHGPVDGKTLGLLRKKEKRATSWPDLIAKVFRIDVKADVDSIHPTEFCHNCWSIMHRKFSSAPCEVYFPRNVTMEWHPHTPSCDICNTARRGLKRKSLQPNLQLSKKLKTVLDQARQARQRKRRAQARISSKDVMKKIANCSKIHLSTKLLAVDFPEHFVKSISCQICEHILADPVETNCKHVFCRVCILRCLKVMGSYCPSCRYPCFPTDLESPVKSFLSVLNSLMVKCPAKECNEEVSLEKYNHHISSHKESKEIFVHINKGGRPRQHLLSLTRRAQKHRLRELKLQVKAFADKEEGGDVKSVCMTLFLLALRARNEHRQADELEAIMQGKGSGLQPAVCLAIRVNTFLSCSQYHKMYRTVKAITGRQIFQPLHALRNAEKVLLPGYHHFEWQPPLKNVSSSTDVGIIDGLSGLSSSVDDYPVDTIAKRFRYDSALVSALMDMEEDILEGMRSQDLDDYLNGPFTVVVKESCDGMGDVSEKHGSGPVVPEKAVRFSFTIMKITIAHSSQNVKVFEEAKPNSELCCKPLCLMLADESDHETLTAILSPLIAEREAMKSSELMLELGGILRTFKFIFRGTGYDEKLVREVEGLEASGSVYICTLCDATRLEASQNLVFHSITRSHAENLERYEVWRSNPYHESVEELRDRVKGVSAKPFIETVPSIDALHCDIGNAAEFYKIFQLEIGEVYKNPNASKEERKRWQATLDKHLRKKMNLKPIMRMNGNFARKLMTKETVDAVCELIPSEERHEALRELMDLYLKMKPVWRSSCPAKECPESLCQYSFNSQRFAELLSTKFKYRYEGKITNYFHKTLAHVPEIIERDGSIGAWASEGNESGNKLFRRFRKMNARQSKCYEMEDVLKHHWLYTSKYLQKFMNAHNALKTSGFTMNPQASLGDPLGIEDSLESQDSMEF

SEQ ID NO: 30929 - protein, 527 aa, Homo sapiens
MSLQMVTVSNNIALIQPGFSLMNFDGQVFFFGQKGWPKRSCPTGVFHLDVKHNHVKLKPTIFSKDSCYLPPLRYPATCTFKGSLESEKHQYIIHGGKTPNNEVSDKIYVMSIVCKNNKKVTFRCTEKDLVGDVPEARYGHSINVVYSRGKSMGALFGGRSYMPSTHRTTEKWNSVADCLPCVFLVDFEFGCATSYILPELQDGLSFHVSIAKNDTIYILGGHSLANNIRPANLYRIRVDLPLGSPAVNCTVLPGGISVSSAILTQTNNDEFVIVGGYQLENQKRMICNIISLEDNKIEIREMETPDWTPDIKHSKIWFGSNTGNGTVFLGIPGDNKQVVSEGFYFYMLKCAEDDTNEEQTTFTNSQTSTEDPGDSTPFEDSEEFCFSAEANSFDGDDEFDTYNEDDEEDESETGYWITCCPTCDVDINTWVPFYSTELNKPAMIYCSHGDGHWVHAQCMDLAERTLIHLSAGSNKYYCNEHVEIARALHTPQRVLPLKKPPMKSLRKKGSGKILTPAKKSFLRRLFD

SEQ ID NO: 30930 - protein, 238 aa, Homo sapiens
MSSGYSSLEEDAEDFFFTARTSFFRRAPQGKPRSGQQDVEKEKETHSYLSKEEIKEKVHKYNLAVTDKLKMTLNSNGIYTGFIKVQMELCKPPQTSPNSGKLSPSSNGCMNTLHISSTNTVGEVIEALLKKFLVTESPAKFALYKRCHREDQVYACKLSDREHPLYLRLVAGPRTDTLSFVLREHEIGEWEAFSLPELQNFLRILDKEEDEQLQNLKRRYTAYRQKLEEALREVWKPD

SEQ ID NO: 30931 - protein, 191 aa, Homo sapiens
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIRSNLPCTPVLVVATQTDQREMGPHRASCVNAMEGKKLAQDVRAKGYLECSALSNRGVQQVFECAVRTAVNQARRRNRRRLFSINECKIF

SEQ ID NO: 30932 - protein, 517 aa, Homo sapiens
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVENGIAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSSLHPVLLPSDVFDQPQPVGNKRIEFHISTDMPAAFKKDLEKEQNCEEKNHDLPATEVDASNIGFGKIFPKPNLDITEEIKEDSDEMPSECISRRELEKGRISREEMETLSVFRSYEPGEPNCRIYVKNLAKHVQEKDLKYIFGRYVDFSSETQRIMFDIRLMKEGRMKGQAFIGLPNEKAAAKALKEANGYVLFGKPMVVQFARSARPKQDPKEGKRKC

SEQ ID NO: 30933 - protein, 305 aa, Homo sapiens
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 30934 - protein, 305 aa, Homo sapiens; identical to SEQ ID NO: 30933

SEQ ID NO: 30935 - protein, 1516 aa, Homo sapiens
MDNQQDKAIVASANGENTLINGVKENDSEDQDVAMKSFAALEAAAPIQPTPVAQKETLMYPRGLLPLPSKKPCMQSPPSPLGLIEAPEHAANSASVNAISLTSGIAKGLNTWSLPNECEKAPFAIMEPAGMSALNGDCLMQPSRTCLGCFMESKDAVDPEPGISLKVGDLNRDYETCAVSDIGIQCINAGENMKYGEQLLSDQLLGFPLHKSRAGDRRETEKPDIDLEDPAQKSYYEALLLDKCNTEEALLANSNQDWGYFETFISESKIELLDLCSKNELSVNLFSEEDVDNYMFDDDESTLGSDVCSLKIRYESFQDNVRDKTTLLMQEDAQFNFFPSVFTTCPKRESKSGALKQSSDFSQFKVPDVSIIWGEEDKNLDKKKGKEEGQEDKGVEKKDGKDNGEKPALNKPCSGTEVEQLKNPKQGHLANSLETSGSFSDDSSFIEISYDAMGEIKDCSRYMARDTNSGSSSSQQNYGLRAKRKVRYSEDYLYDVDSLEGEKVNERKEWLPVGSKEEDDDEWCPKKRRKVTRKEPPVIIKYIIINRFKGEKNMLVKLGKVDASETTVNLSENQLNKYAKLAPLKGFWQKKKKQRNTNTDSIKTPFSQKQSFEPGSFEVSFLPPARKRKSKLGNRHRIQRIPSIEISASSKQISLCNDQRHASNHKEDGGLKGTLKSAPLGAPSCANGSHLNDITGPDSVKVKAQDTEFKGPERKVLNKIKFKSEARLKSKKVKAAGQESKPIVQMSPLLENQSSKANLKNEVIPGTSNSSRLSEFHEAKAAKSSTFLPTTCSSEMPLSSANVTTNIPVIPGGYLQTLLDASDLSNNTSISYFSHHSPEQNEGSLTQTEKSFVPLQPTQDCVLTSSSDSELQQSSHNFKMESSNYRNVWPNKATSGTQEFMAEVSREIAPTQSSEFGASQVVSMENNLTPTTYNPICLNSGGSNCNKVLYDSMQDTQLPSDDSYQLCHFNNGEICFPFQQGPVNMDDGRLFSFDSMAPLSVSSSNYCSLSLKSCEKDGDDDITDDFLAHCSPKLVIQQSIDEIAPLKESTDLLDISNFTPDKFRHSSLSEMSPPDTPSLSPQITRCESMKTLGTLKGFQEGVPGPLDSVEKIKWDCSTLSRQVQMEDGFTLNNHQFQFHMFNDEDSVSLLQKNPCLSTFNDPSGQISTNNKVSKSRKKSSPSKSGAMNQSSSQKNTRKKSLKGNNKGIEKPPGKNSRQVPKSTKKGKYMAAINGEKMQIGIGRGGSQTNTISSTGKTLAECIQHGGPMASMKMPSQKGLSGDWALGKESSPGWSDMSMGTNTNSLLDDDQREFQEPSYILSNIASGMADVQRFMMASIEPLWEPMEHHGDPNIFYSPESNSLKLKTLKILAGTPQESKKKINSGSQGATKNHRSIKGVSKSNGKTAIGDPGRANMPGYNEDSRSTFFDKKYSNMSTLGNNGPTHKKLYRHKSSSKALRDEKCKGKHMEREQVHKDESGTASFEKLRDSDYNLLKAETTFWVLPVFEEETRIFQKDI

SEQ ID NO: 30936 - protein, 532 aa, Homo sapiens
MAPSFTARIQLFLLRALGFLIGLVGRAALVLGGPKFASKTPRPVTEPLLLLSGMQLAKLIRQRKVKCIDVVQAYINRIKDVNPMINGIVKYRFEEAMREAHAVDQKLAEKQEDEATLENKWPFLGVPLTVKEAFQLQGMPNSSGLMNRRDAIAKTDATVVALLKGAGAIPLGITNCSELCMWYESSNKIYGRSNNPYDLQHIVGGSSGGEGCTLAAACSVIGVGSDIGGSIRMPAFFNGIFGHKPSPGVVPNKGQFPLAVGAQELFLCTGPMCRYAEDLAPMLKVMAGPGIKRLKLDTKVHLKDLKFYWMEHDGGSFLMSKVDQDLIMTQKKVVVHLETILGASVQHVKLKKMKYSFQLWIAMMSAKGHDGKEPVKFVDLLGDHGKHVSPLWELIKWCLGLSVYTIPSIGLALLEEKLRYSNEKYQKFKAVEESLRKELVDMLGDDGVFLYPSHPTVAPKHHVPLTRPFNFAYTGVFSALGLPVTQCPLGLNAKGLPLGIQVVAGPFNDHLTLAVAQYLEKTFGGWVCPGKF

SEQ ID NO: 30937 - protein, 416 aa, Homo sapiens
MAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 30938 - protein, 97 aa, Homo sapiens
MCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 30939 - protein, 445 aa, Homo sapiens
MEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 30940 - protein, 574 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 30941 - protein, 110 aa, Homo sapiens
MARGNQRELARQKNMKKTQEISKGKRKEDSLTASQRKQSSGGQKSESKMSAGPHLPLKAPRENPCFPLPAAGGSRYYLAYGSITPISAFVFVVFFSVFFPSFYEDFCCWI

SEQ ID NO: 30942 - protein, 110 aa, Homo sapiens; identical to SEQ ID NO: 30941

SEQ ID NO: 30943 - protein, 639 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 30944 - protein, 638 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMIPPRGGDGPSHESEDFPRPLVTLPGRQPQQRPWWTGWFGKAA

SEQ ID NO: 30945 - protein, 80 aa, Homo sapiens
MATGANATPLDFPSKKRKRSRWNQDTMEQKTVIPGMPTVIPPGLTREQERAYIGKYTFCIQMHFEIVTIYSEQDLHFLKV

SEQ ID NO: 30946 - protein, 548 aa, Homo sapiens
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQRSLPAAAMARAMRVRTFRAHW

SEQ ID NO: 30947 - protein, 494 aa, Homo sapiens
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKEKSRSRSHSAGKSRSKSKDQAEEKIQNNDNVGKPKSRSPSRHKSKSKSRSRSQERRVEEEKRGSVSRGRSQEKSLRQSRSRSRSKGGSRSRSRSRSKSKDKRKGRKRSREESRSRSRSRSKSERSRKRGSKRDSKAGSSKKKKKEDTDRSQSRSPSRSVSKEREHAKSESSQREGRGESENAGTNQETRSRSRSNSKSKPNLPSESRSRSKSASKTRSRSKSRSRSASRSPSRSRSRSHSRS

SEQ ID NO: 30948 - protein, 128 aa, Homo sapiens
MDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGTTGIREDPDVCLKAP

SEQ ID NO: 30949 - protein, 335 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 30950 - protein, 577 aa, Homo sapiens
MEGSGGGAGERAPLLGARRAAAAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 30951 - protein, 365 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 30952 - protein, 344 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 30953 - protein, 365 aa, Homo sapiens; identical to SEQ ID NO: 30951

SEQ ID NO: 30954 - protein, 925 aa, Homo sapiens
MPRKGTQPSTARRREEGPPPPSPDGASSDAEPEPPSGRTESPATAAAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRPSKGTRLCLAYRERNKRY

SEQ ID NO: 30955 - protein, 1288 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 30956 - protein, 1288 aa, Homo sapiens; identical to SEQ ID NO: 30955

SEQ ID NO: 30957 - protein, 540 aa, Homo sapiens
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRLIELHSPDSRNTLILRCKDTATAHSWFVAIHTNIMALLPQVLAELNAMLGATSTAGGSKEVKHIAWLAEQAKLDGGRQQWRPVLMAVTEKDLLLYDCMPWTRDAWASPCHSYPLVATRLVHSGSGCRSPSLGSDLTFATRTGSRQGIEMHLFRVETHRDLSSWTRILVQGCHAAAELIKEVSLGCMLNGQEVRLTIHYENGFTISRENGGSSSILYRYPFERLKMSADDGIRNLYLDFGGPEGELTMDLHSCPKPIVFVLHTFLSAKVTRMGLLV

SEQ ID NO: 30958 - protein, 267 aa, Homo sapiens
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRQN

SEQ ID NO: 30959 - protein, 1332 aa, Homo sapiens
MQQAPQPYEFFSEENSPKWRGLLVSALRKVQVQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPCSSGELNYYDLVRTEIAEERQYLRELNMIIKVFREAFLSDRKLFKPSVYEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNHQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYTSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRVLNVFRHWVDHHYYDFERDLELLERLESFISSVRGKAMKKWVESIAKIIRRKKQAQANGVSHNITFESPPPPIEWHISKPGQFETFDLMTLDPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKRKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 30960 - protein, 89 aa, Homo sapiens
MNSQQQKQPCTPPPQPQQQQVKQPCQPPPQEPCIPKTKEPCHPKVPEPCHPKVPEPCQPKVPEPCQPKVPEPCPSTVTPAPAQQKTKQK

SEQ ID NO: 30961 - protein, 917 aa, Homo sapiens
MEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNFEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 30962 - protein, 384 aa, Homo sapiens
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 30963 - protein, 269 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 30964 - protein, 268 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCR

SEQ ID NO: 30965 - protein, 269 aa, Homo sapiens; identical to SEQ ID NO: 30963

SEQ ID NO: 30966 - protein, 496 aa, Homo sapiens
MAGEITETGELYSSYVGLVYMFNLIVGTGALTMPKAFATAGWLVSLVLLVFLGFMSFMTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIAFAVMIVLALIRIGHGQGEGHPPLADFSGVRNLFGVCVYSFMCQHSLPSLITPVSSKRHLTRLVFLDYVLILAFYGLLSFTAIFCFRGDSLMDMYTLNFARCDVVGLAAVRFFLGLFPVFTISTNFPIIAVTLRNNWKTLFHREGGTYPWVVDRVVFPTITLVPPVLVAFCTHDLESLVGITGAYAGTGIQYVIPAFLVYHCRRDTQLAFGCGVSNKHRSPFRHTFWVGFVLLWAFSCFIFVTANIILSETKL

SEQ ID NO: 30967 - protein, 123 aa, Homo sapiens
MLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTR

SEQ ID NO: 30968 - protein, 1690 aa, Homo sapiens
MATGSAQGNFTGHTKKTNGNNGTNGALVQSPSNQSALGAGGANSNGSAARVWGVATGSSSGLAHCSVSGGDGKMDTMIGDGRSQNCWGASNSNAGINLNLNPNANPAAWPVLGHEGTVATGNPSSICSPVSAIGQNMGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPGRKVSSGWGEMPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPKKGLQKGMKTSGKQDEAWIMSRLIKQLTDMGFPREPAEEALKSNNMNLDQAMSALLEKKVDVDKRGLGVTDHNGMAAKPLGCRPPISKESSVDRPTFLDKDGGLVEEPTPSPFLPSPSLKLPLSHSALPSQALGGIASGLGMQNLNSSRQIPSGNLGMFGNSGAAQARTMQQPPQPPVQPLNSSQPSLRAQVPQFLSPQVQAQLLQFAAKNIGLNPALLTSPINPQHMTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGKLSDIKSTWSSGPTSHTQASLSHELWKVPRNSTAPTRPPPGLTNPKPSSTWGASPLGWTSSYSSGSAWSTDTSGRTSSWLVLRNLTPQIDGSTLRTLCLQHGPLITFHLNLTQGNAVVRYSSKEEAAKAQKSLHMCVLGNTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 30969 - protein, 526 aa, Homo sapiens
MDVRFYPPPAQPAAAPDAPCLGPSPCLDPYYCNKFDGENMYMSMTEPSQDYVPASQSYPGPSLESEDFNIPPITPPSLPDHSLVHLNEVESGYHSLCHPMNHNGLLPFHPQNMDLPEITVSNMLGQDGTLLSNSISVMPDIRNPEGTQYSSHPQMAAMRPRGQPADIRQQPGMMPHGQLTTINQSQLSAQLGLNMGGSNVPHNSPSPPGSKSATPSPSSSVHEDEGDDTSKINGGEKRPASDMGKKPKTPKKKKKKDPNEPQKPVSAYALFFRDTQAAIKGQNPNATFGEVSKIVASMWDGLGEEQKQVYKKKTEAAKKEYLKQLAAYRASLVSKSYSEPVDVKTSQPPQLINSKPSVFHGPSQAHSALYLSSHYHQQPGMNPHLTAMHPSLPRNIAPKPNNQMPVTVSIANMAVSPPPPLQISPPLHQHLNMQQHQPLTMQQPLGNQLPMQVQSALHSPTMQQGFTLQPDYQTIINPTSTAAQVVTQAMEYVRSGCRNPPPQPVDWNNDYCSSGGMQRDKALYLT

SEQ ID NO: 30970 - protein, 516 aa, Homo sapiens
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 30971 - protein, 488 aa, Homo sapiens
MTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 30972 - protein, 842 aa, Homo sapiens
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWAIQGSLTRRERRASGVRTRRSQGSSAMASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 30973 - protein, 857 aa, Homo sapiens
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQSKRKSECINQNPAASSNHWQIPELARKVNTEQKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNQMAKGTTEEMKYVLGQLVGLNSPNSILKAAKTLYEHYSGGESHNSSSSKTFEKKRGKK

SEQ ID NO: 30974 - protein, 289 aa, Homo sapiens
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRVVGKKGESH

SEQ ID NO: 30975 - protein, 623 aa, Homo sapiens
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLADCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 30976 - protein, 661 aa, Homo sapiens
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLAGTSVSRFWIFSQVPGHGPNLRLSNLTRASFVSHYILQKYCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 30977 - protein, 153 aa, Homo sapiens
MMASMRVVKELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 30978 - protein, 87 aa, Homo sapiens
MIKFTTKIYHPNVDENGQICLPIISSENWKPCTKTCQVLEALNVLVNRPNIREPLRMDLADLLTQNPELFRKNAEEFTLRFGVDRPS

SEQ ID NO: 30979 - protein, 913 aa, Homo sapiens
MGDSRDLCPHLDSIGEVTKEDLLLKSKGTCQSCGVTGPNLWACLQVACPYVGCGESFADHSTIHAQAKKHNLTVNLTTFRLWCYACEKEVFLEQRLAAPLLGSSSKFSEQDSPPPSHPLKAVPIAVADEGESESEDDDLKPRGLTGMKNLGNSCYMNAALQALSNCPPLTQFFLECGGLVRTDKKPALCKSYQKLVSEVWHKKRPSYVVPTSLSHGIKLVNPMFRGYAQQDTQEFLRCLMDQLHEELKEPVVATVALTEARDSDSSDTDEKREGDRSPSEDEFLSCDSSSDRGEGDGQGRGGGSSQAETELLIPDEAGRAISEKERMKDRKFSWGQQRTNSEQVDEDADVDTAMAALDQPAEAQPPSPRSSSPCRTPEPDNDAHLRSSSRPCSPVHHHEGHAKLSSSPPRASPVRMAPSYVLKKAQVLSAGSRRRKEQRYRSVISDIFDGSILSLVQCLTCDRVSTTVETFQDLSLPIPGKEDLAKLHSAIYQNVPAKPGACGDSYAAQGWLAFIVEYIRRFVVSCTPSWFWGPVVTLEDCLAAFFAADELKGDNMYSCERCKKLRNGVKYCKVLRLPEILCIHLKRFRHEVMYSFKINSHVSFPLEGLDLRPFLAKECTSQITTYDLLSVICHHGTAGSGHYIAYCQNVINGQWYEFDDQYVTEVHETVVQNAEGYVLFYRKSSEEAMRERQQVVSLAAMREPSLLRFYVSREWLNKFNTFAEPGPITNQTFLCSHGGIPPHKYHYIDDLVVILPQNVWEHLYNRFGGGPAVNHLYVCSICQVEIEALAKRRRIEIDTFIKLNKAFQAEESPGVIYCISMQWFREWEAFVKGKDNEPPGPIDNSRIAQVKGSGHVQLKQGADYGQISEETWTYLNSLYGGGPEIAIRQSVAQPLGPENLHGEQKIEAETRAV

SEQ ID NO: 30980 - protein, 913 aa, Homo sapiens; identical to SEQ ID NO: 30979

SEQ ID NO: 30981 - protein, 1406 aa, Homo sapiens
MDMVENADSLQAQERKDILMKYDKGHRAGLPEDKGPEPVGINSSIDRFGILHETELPPVTAREAKKIRREMTRTSKWMEMLGEWETYKHSSKLIDRVYKGIPMNIRGPVWSVLLNIQEIKLKNPGRYQIMKERGKRSSEHIHHIDLDVRTTLRNHVFFRDRYGAKQRELFYILLAYSEYNPEVGYCRDLSHITALFLLYLPEEDAFWALVQLLASERHSLPGFHSPNGGTVQGLQDQQEHVVPKSQPKTMWHQDKEGLCGQCASLGCLLRNLIDGISLGLTLRLWDVYLVEGEQVLMPITSIALKVQQKRLMKTSRCGLWARLRNQFFDTWAMNDDTVLKHLRASTKKLTRKQGDLPPPAKREQGSLAPRPVPASRGGKTLCKGYRQAPPGPPAQFQRPICSASPPWASRFSTPCPGGAVREDTYPVGTQGVPSLALAQGGPQGSWRFLEWKSMPRLPTDLDIGGPWFPHYDFEWSCWVRAISQEDQLATCWQAEHCGEVHNKDMSWPEEMSFTANSSKIDRQKVPTEKGATGLSNLGNTCFMNSSIQCVSNTQPLTQYFISGRHLYELNRTNPIGMKGHMAKCYGDLVQELWSGTQKSVAPLKLRRTIAKYAPKFDGFQQQDSQELLAFLLDGLHEDLNRVHEKPYVELKDSDGRPDWEVAAEAWDNHLRRNRSIIVDLFHGQLRSQVKCKTCGHISVRFDPFNFLSLPLPMDSYMDLEITVIKLDGTTPVRYGLRLNMDEKYTGLKKQLRDLCGLNSEQILLAEVHDSNIKNFPQDNQKVQLSVSGFLCAFEIPVPSSPISASSPTQIDFSSSPSTNGMFTLTTNGDLPKPIFIPNGMPNTVVPCGTEKNFTNGMVNGHMPSLPDSPFTGYIIAVHRKMMRTELYFLSPQENRPSLFGMPLIVPCTVHTRKKDLYDAVWIQVSWLARPLPPQEASIHAQDRDNCMGYQYPFTLRVVQKDGNSCAWCPQYRFCRGCKIDCGEDRAFIGNAYIAVDWHPTALHLRYQTSQERVVDKHESVEQSRRAQAEPINLDSCLRAFTSEEELGESEMYYCSKCKTHCLATKKLDLWRLPPFLIIHLKRFQFVNDQWIKSQKIVRFLRESFDPSAFLVPRDPALCQHKPLTPQGDELSKPRILAREVKKVDAQSSAGKEDMLLSKSPSSLSANISSSPKGSPSSSRKSGTSCPSSKNSSPNSSPRTLGRSKGRLRLPQIGSKNKPSSSKKNLDASKENGAGQICELADALSRGHMRGGSQPELVTPQDHEVALANGFLYEHEACGNGCGDGYSNGQLGNHSEEDSTDDQREDTHIKPIYNLYAISCHSGILSGGHYITYAKNPNCKWYCYNDSSCEELHPDEIDTDSAYILFYEQQGIDYAQFLPKIDGKKMADTSSTDEDSESDYEKYSMLQ

SEQ ID NO: 30982 - protein, 3628 aa, Homo sapiens
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKGTHSGEFIYGLENFVYKDIKPGRKRKKHKKHFKKPFKGLDRSKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLEQELEIQE

SEQ ID NO: 30983 - protein, 3710 aa, Homo sapiens
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLENHIKKLEGETYRYHCAIPGSKKTILMVTNRRVLCIKEVEILGLMCVDWQCPFEDFVFPPSVSENVLKISVKEQGLFHKKDSANQGCVRKVYLKDTATAERACNAIEDAQSTRQQQKLMKQSSVRLLRPQLPS

SEQ ID NO: 30984 - protein, 3585 aa, Homo sapiens
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLEQELEIQE

SEQ ID NO: 30985 - protein, 3753 aa, Homo sapiens
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKGTHSGEFIYGLENFVYKDIKPGRKRKKHKKHFKKPFKGLDRSKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLENHIKKLEGETYRYHCAIPGSKKTILMVTNRRVLCIKEVEILGLMCVDWQCPFEDFVFPPSVSENVLKISVKEQGLFHKKDSANQGCVRKVYLKDTATAERACNAIEDAQSTRQQQKLMKQSSVRLLRPQLPS

SEQ ID NO: 30986 - protein, 1432 aa, Homo sapiens
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKFLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 30987 - protein, 619 aa, Homo sapiens
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 30988 - protein, 312 aa, Homo sapiens
MPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 30989 - protein, 707 aa, Homo sapiens
MTTFKEAMTFKDVAVVFTEEELGLLDLAQRKLYRDVMLENFRNLLSVGHQAFHRDTFHFLREEKIWMMKTAIQREGNSGDKIQTEMETVSEAGTHQEWSFQQIWEKIASDLTRSQDLVINSSQFSKEGDFPCQTEAGLSVIHTRQKSSQGNGYKPSFSDVSHFDFHQQLHSGEKSHTCDECGKNFCYISALRIHQRVHMGEKCYKCDVCGKEFSQSSHLQTHQRVHTGEKPFKCVECGKGFSRRSALNVHHKLHTGEKPYNCEECGKAFIHDSQLQEHQRIHTGEKPFKCDICGKSFCGRSRLNRHSMVHTAEKPFRCDTCDKSFRQRSALNSHRMIHTGEKPYKCEECGKGFICRRDLYTHHMVHTGEKPYNCKECGKSFRWASCLLKHQRVHSGEKPFKCEECGKGFYTNSQCYSHQRSHSGEKPYKCVECGKGYKRRLDLDFHQRVHTGEKLYNCKECGKSFSRAPCLLKHERLHSGEKPFQCEECGKRFTQNSHLHSHQRVHTGEKPYKCEKCGKGYNSKFNLDMHQKVHTGERPYNCKECGKSFGWASCLLKHQRLRSGEKPFKCEECGKRFTQNSQLHSHQRVHTGEKPYKCDECGKGFSWSSTRLTHQRRHSRETPLKCEQHGKNIVQNSFSKVQEKVHSVEKPYKCEDCGKGYNRRLNLDMHQRVHMGEKTWKCRECDMCFSQASSLRLHQNVHVGEKP

SEQ ID NO: 30990 - protein, 706 aa, Homo sapiens
MTTLKEAVTFKDVAVVFTEEELRLLDLAQRKLYREVMLENFRNLLSVGHQSLHRDTFHFLKEEKFWMMETATQREGNLGGKIQMEMETVSESGTHEGLFSHQTWEQISSDLTRFQDSMVNSFQFSKQDDMPCQVDAGLSIIHVKTETSEGRTCKKSFSDVSVLDLHQQLQSREKSHTCDECGKSFCYSSALRIHQRVHMGEKLYNCDVCGKEFNQSSHQQIHQRIHTGEKPFKCEQCGKGFSRRSGLYVHRKLHTGVKPHICEKCGKAFIHDSQLQEHQRIHTGEKPFKCDICCKSFRSRANLNRHSMVHMREKPFRCDTCGKSFGLKSALNSHRMVHTGEKRYKCEECGKRFIYRQDLYKHQIDHTGEKPYNCKECGKSFRWASGLSRHVRVHSGETTFKCEECGKGFYTNSQRYSHQRAHSGEKPYRCEECGKGYKRRLDLDFHQRVHRGEKPYNCKECGKSFGWASCLLNHQRIHSGEKPFKCEECGKRFTQNSQLYTHRRVHSGEKPFKCEECGKRFTQNSQLYSHRRVHTGVKPYKCEECGKGFNSKFNLDMHQRVHTGERPYNCKECGKSFSRASSILNHKRLHGDEKPFKCEECGKRFTENSQLHSHQRVHTGEKPYKCEKCGKSFRWASTHLTHQRLHSREKLLQCEDCGKSIVHSSCLKDQQRDQSGEKTSKCEDCGKRYKRRLNLDTLLSLFLNDT

SEQ ID NO: 30991 - protein, 519 aa, Homo sapiens
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 30992 - protein, 374 aa, Homo sapiens
MSVPAFIDISEEDQAAELRAYLKSKGAEISEENSEGGLHVDLAQIIEACDVCLKEDDKDVESVMNSVVSLLLILEPDKQEALIESLCEKLVKFREGERPSLRLQLLSNLFHGMDKNTPVRYTVYCSLIKVAASCGAIQYIPTELDQVRKWISDWNLTTEKKHTLLRLLYEALVDCKKSDAASKVMVELLGSYTEDNASQARVDAHRCIVRALKDPNAFLFDHLLTLKPVKFLEGELIHDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 30993 - DNA, 17 bp, Homo sapiens
gatcacctgagtcagag

SEQ ID NO: 30994 - DNA, 17 bp, Homo sapiens
gatcttttgacagttat

SEQ ID NO: 30995 - DNA, 17 bp, Homo sapiens
gatctttgtatgatgat

SEQ ID NO: 30996 - DNA, 17 bp, Homo sapiens
gatctggaatctgttaa

SEQ ID NO: 30997 - DNA, 17 bp, Homo sapiens
gatccaggtgtccaggc

SEQ ID NO: 30998 - DNA, 17 bp, Homo sapiens
gatcgctctacgtatct

SEQ ID NO: 30999 - DNA, 17 bp, Homo sapiens
gatcgtacaagaagagg

SEQ ID NO: 31000 - DNA, 17 bp, Homo sapiens
gatccagtgagaataag

SEQ ID NO: 31001 - DNA, 17 bp, Homo sapiens
gatcaccggagcctgga

SEQ ID NO: 31002 - DNA, 17 bp, Homo sapiens
gatcttctatctacaaa

SEQ ID NO: 31003 - DNA, 17 bp, Homo sapiens
gatcgtggatattaagc

SEQ ID NO: 31004 - DNA, 17 bp, Homo sapiens
gatctgagactggagag

SEQ ID NO: 31005 - DNA, 17 bp, Homo sapiens
gatctgcccacctgagc

SEQ ID NO: 31006 - DNA, 17 bp, Homo sapiens
gatctgggtgttccttt

SEQ ID NO: 31007 - DNA, 17 bp, Homo sapiens
gatcatagtaatgagtt

SEQ ID NO: 31008 - DNA, 17 bp, Homo sapiens
gatcccagatgtcacac

SEQ ID NO: 31009 - DNA, 17 bp, Homo sapiens
gatccccatggatgtcc

SEQ ID NO: 31010 - DNA, 17 bp, Homo sapiens
gatcttcctatttgagt

SEQ ID NO: 31011 - DNA, 17 bp, Homo sapiens
gatctttttttttcaaa

SEQ ID NO: 31012 - DNA, 17 bp, Homo sapiens
gatcttgctctctttta

SEQ ID NO: 31013 - DNA, 17 bp, Homo sapiens
gatcctgctctcaagaa

SEQ ID NO: 31014 - DNA, 17 bp, Homo sapiens
gatcagtgaaacaaaac

SEQ ID NO: 31015 - DNA, 17 bp, Homo sapiens
gatcgcttgagtcagga

SEQ ID NO: 31016 - DNA, 17 bp, Homo sapiens
gatcttatttctactaa

SEQ ID NO: 31017 - DNA, 17 bp, Homo sapiens
gatcaaagaacaggaga

SEQ ID NO: 31018 - DNA, 17 bp, Homo sapiens
gatcatggatgaagacg

SEQ ID NO: 31019 - DNA, 17 bp, Homo sapiens
gatcctggaaacagact

SEQ ID NO: 31020 - DNA, 17 bp, Homo sapiens
gatcttccagcctcagt

SEQ ID NO: 31021 - DNA, 17 bp, Homo sapiens
gatccaaatgttattta

SEQ ID NO: 31022 - DNA, 17 bp, Homo sapiens
gatctctgcaggaccgt

SEQ ID NO: 31023 - DNA, 17 bp, Homo sapiens
gatcagttgagaccagg

SEQ ID NO: 31024 - DNA, 17 bp, Homo sapiens
gatcctccctcctgagc

SEQ ID NO: 31025 - DNA, 17 bp, Homo sapiens
gatctcaaacccttgct

SEQ ID NO: 31026 - DNA, 17 bp, Homo sapiens
gatcagtgttacccagc

SEQ ID NO: 31027 - DNA, 17 bp, Homo sapiens
gatcatgctgtacaaca

SEQ ID NO: 31028 - DNA, 17 bp, Homo sapiens
gatcaggcaagccgcta

SEQ ID NO: 31029 - DNA, 17 bp, Homo sapiens
gatctcaatcaacttaa

SEQ ID NO: 31030 - DNA, 17 bp, Homo sapiens
gatcgccctctgctgtt

SEQ ID NO: 31031 - DNA, 17 bp, Homo sapiens
gatcttctgagtttaac

SEQ ID NO: 31032 - DNA, 17 bp, Homo sapiens
gatctttctgaagaatt

SEQ ID NO: 31033 - DNA, 17 bp, Homo sapiens
gatctcaactttcttcc

SEQ ID NO: 31034 - DNA, 17 bp, Homo sapiens
gatcccatccccttgtc

SEQ ID NO: 31035 - DNA, 17 bp, Homo sapiens
gatcagatggaatatga

SEQ ID NO: 31036 - DNA, 17 bp, Homo sapiens
gatcgcttgagcctaac

SEQ ID NO: 31037 - DNA, 17 bp, Homo sapiens
gatcttgcctgcatgaa

SEQ ID NO: 31038 - DNA, 17 bp, Homo sapiens
gatctgcaaagacaagt

SEQ ID NO: 31039 - DNA, 17 bp, Homo sapiens
gatcctggaggtggcat

SEQ ID NO: 31040 - DNA, 17 bp, Homo sapiens
gatcccatcacacacac

SEQ ID NO: 31041 - DNA, 17 bp, Homo sapiens
gatcaaaaacagagtat

SEQ ID NO: 31042 - DNA, 17 bp, Homo sapiens
gatctaacaacaaattt

SEQ ID NO: 31043 - DNA, 17 bp, Homo sapiens
gatctcgggaatccatg

SEQ ID NO: 31044 - DNA, 17 bp, Homo sapiens
gatcttcacaagcacat

SEQ ID NO: 31045 - DNA, 17 bp, Homo sapiens
gatcgagatgatgctca

SEQ ID NO: 31046 - DNA, 17 bp, Homo sapiens
gatcacagaacaagtca

SEQ ID NO: 31047 - DNA, 17 bp, Homo sapiens
gatcgagaagatgacca

SEQ ID NO: 31048 - DNA, 17 bp, Homo sapiens
gatcattttcccatctt

SEQ ID NO: 31049 - DNA, 17 bp, Homo sapiens
gatctcagtttgaagta

SEQ ID NO: 31050 - DNA, 17 bp, Homo sapiens
gatctgttttgaaaaag

SEQ ID NO: 31051 - DNA, 17 bp, Homo sapiens
gatctcctttgagtatg

SEQ ID NO: 31052 - DNA, 17 bp, Homo sapiens
gatctaaatccagcttc

SEQ ID NO: 31053 - DNA, 17 bp, Homo sapiens
gatcccagtgcttcatg

SEQ ID NO: 31054 - DNA, 17 bp, Homo sapiens
gatctcaaaatgaagct

SEQ ID NO: 31055 - DNA, 17 bp, Homo sapiens
gatcggcagtggtggag

SEQ ID NO: 31056 - DNA, 17 bp, Homo sapiens
gatcatcaccactgaca

SEQ ID NO: 31057 - DNA, 17 bp, Homo sapiens
gatcaagaacctgggct

SEQ ID NO: 31058 - DNA, 17 bp, Homo sapiens
gatcaagtgaaagtgca

SEQ ID NO: 31059 - DNA, 17 bp, Homo sapiens
gatctatttcaaccttg

SEQ ID NO: 31060 - DNA, 17 bp, Homo sapiens
gatcagtagtcagcctg

SEQ ID NO: 31061 - DNA, 17 bp, Homo sapiens
gatcacaaggcagccct

SEQ ID NO: 31062 - DNA, 17 bp, Homo sapiens
gatccagttcacgcagt

SEQ ID NO: 31063 - DNA, 17 bp, Homo sapiens
gatcagtcttgtggttc

SEQ ID NO: 31064 - DNA, 17 bp, Homo sapiens
gatctctaaatgcttct

SEQ ID NO: 31065 - DNA, 17 bp, Homo sapiens
gatcataaggtatttgt

SEQ ID NO: 31066 - DNA, 17 bp, Homo sapiens
gatctggctctggatgg

SEQ ID NO: 31067 - DNA, 17 bp, Homo sapiens
gatccaagttgagattt

SEQ ID NO: 31068 - DNA, 17 bp, Homo sapiens
gatcattaattttctac

SEQ ID NO: 31069 - DNA, 17 bp, Homo sapiens
gatcctgctgtctagtt

SEQ ID NO: 31070 - DNA, 17 bp, Homo sapiens
gatcccataacaggcta

SEQ ID NO: 31071 - DNA, 17 bp, Homo sapiens
gatcattttcaaaagtg

SEQ ID NO: 31072 - DNA, 17 bp, Homo sapiens
gatccaaagcatcaacc

SEQ ID NO: 31073 - DNA, 17 bp, Homo sapiens
gatcagcaaacattcca

SEQ ID NO: 31074 - DNA, 17 bp, Homo sapiens
gatctttttttttgccc

SEQ ID NO: 31075 - DNA, 17 bp, Homo sapiens
gatccagattcccagga

SEQ ID NO: 31076 - DNA, 17 bp, Homo sapiens
gatctgccagttggtaa

SEQ ID NO: 31077 - DNA, 17 bp, Homo sapiens
gatcaatatggaaaacc

SEQ ID NO: 31078 - DNA, 17 bp, Homo sapiens
gatctctaagaagtatt

SEQ ID NO: 31079 - DNA, 17 bp, Homo sapiens
gatcactgaggtcaaga

SEQ ID NO: 31080 - DNA, 17 bp, Homo sapiens
gatcttaaattgggttg

SEQ ID NO: 31081 - DNA, 17 bp, Homo sapiens
gatcagataaaactatt

SEQ ID NO: 31082 - DNA, 17 bp, Homo sapiens
gatccgaactctcagtg

SEQ ID NO: 31083 - DNA, 17 bp, Homo sapiens
gatcaagtctttcaggc

SEQ ID NO: 31084 - DNA, 17 bp, Homo sapiens
gatcgcttgaacccaga

SEQ ID NO: 31085 - DNA, 17 bp, Homo sapiens
gatcatgtgctttgcag

SEQ ID NO: 31086 - DNA, 17 bp, Homo sapiens
gatcctcccaactgtat

SEQ ID NO: 31087 - DNA, 17 bp, Homo sapiens
gatccactgcgtccgtc

SEQ ID NO: 31088 - DNA, 17 bp, Homo sapiens
gatcccatcaaaatatt

SEQ ID NO: 31089 - DNA, 17 bp, Homo sapiens
gatctgctttttttcct

SEQ ID NO: 31090 - DNA, 17 bp, Homo sapiens
gatccacaggtgtggca

SEQ ID NO: 31091 - DNA, 17 bp, Homo sapiens
gatctgttaaataaaaa

SEQ ID NO: 31092 - DNA, 17 bp, Homo sapiens
gatctaaatttggccca

SEQ ID NO: 31093 - DNA, 17 bp, Homo sapiens
gatctgctgctcctttc

SEQ ID NO: 31094 - DNA, 17 bp, Homo sapiens
gatctgattctgaagca

SEQ ID NO: 31095 - DNA, 17 bp, Homo sapiens
gatctgtgtgcatatgg

SEQ ID NO: 31096 - DNA, 17 bp, Homo sapiens
gatctccttactggagc

SEQ ID NO: 31097 - DNA, 17 bp, Homo sapiens
gatctctattcactgct

SEQ ID NO: 31098 - DNA, 17 bp, Homo sapiens
gatctatttccatccac

SEQ ID NO: 31099 - DNA, 17 bp, Homo sapiens
gatccctcatgcatggc

SEQ ID NO: 31100 - DNA, 17 bp, Homo sapiens
gatcatgctgctggact

SEQ ID NO: 31101 - DNA, 17 bp, Homo sapiens
gatcataacaggcaaaa

SEQ ID NO: 31102 - DNA, 17 bp, Homo sapiens
gatcattgtatatgtca

SEQ ID NO: 31103 - DNA, 17 bp, Homo sapiens
gatctaatctcaaacta

SEQ ID NO: 31104 - DNA, 17 bp, Homo sapiens
gatctttgttctataac

SEQ ID NO: 31105 - DNA, 17 bp, Homo sapiens
gatccatttggaaatga

SEQ ID NO: 31106 - DNA, 17 bp, Homo sapiens
gatcccagtttgtgagc

SEQ ID NO: 31107 - DNA, 17 bp, Homo sapiens
gatcatcttcttcgctc

SEQ ID NO: 31108 - DNA, 17 bp, Homo sapiens
gatctcaacgaaggcaa

SEQ ID NO: 31109 - DNA, 17 bp, Homo sapiens
gatcctgccacttactt

SEQ ID NO: 31110 - DNA, 17 bp, Homo sapiens
gatccatacaaagtgtc

SEQ ID NO: 31111 - DNA, 17 bp, Homo sapiens
gatctacacacccaaca

SEQ ID NO: 31112 - DNA, 17 bp, Homo sapiens
gatcagttttaaactct

SEQ ID NO: 31113 - DNA, 17 bp, Homo sapiens
gatctaagaaatgaaca

SEQ ID NO: 31114 - DNA, 17 bp, Homo sapiens
gatcacaagcgtgagcc

SEQ ID NO: 31115 - DNA, 17 bp, Homo sapiens
gatcttcctttattatt

SEQ ID NO: 31116 - DNA, 17 bp, Homo sapiens
gatctgttctgcagccc

SEQ ID NO: 31117 - DNA, 17 bp, Homo sapiens
gatctgaaaattcagaa

SEQ ID NO: 31118 - DNA, 17 bp, Homo sapiens
gatctcatttatagctc

SEQ ID NO: 31119 - DNA, 17 bp, Homo sapiens
gatcaattgataactgc

SEQ ID NO: 31120 - DNA, 17 bp, Homo sapiens
gatctaaaagaagttat

SEQ ID NO: 31121 - DNA, 17 bp, Homo sapiens
gatctctccattcagaa

SEQ ID NO: 31122 - DNA, 17 bp, Homo sapiens
gatcttttgcccatcat

SEQ ID NO: 31123 - DNA, 17 bp, Homo sapiens
gatcctctgtcacagca

SEQ ID NO: 31124 - DNA, 17 bp, Homo sapiens
gatctctcaactttaac

SEQ ID NO: 31125 - DNA, 17 bp, Homo sapiens
gatcatcttgagatatt

SEQ ID NO: 31126 - DNA, 17 bp, Homo sapiens
gatcaaagaccattttt

SEQ ID NO: 31127 - DNA, 17 bp, Homo sapiens
gatcaagaagtagttgt

SEQ ID NO: 31128 - DNA, 17 bp, Homo sapiens
gatcttaccagtccttt

SEQ ID NO: 31129 - DNA, 17 bp, Homo sapiens
gatcagtttttaatgta

SEQ ID NO: 31130 - DNA, 17 bp, Homo sapiens
gatcataccactgtgtt

SEQ ID NO: 31131 - DNA, 17 bp, Homo sapiens
gatctgtcttacaagaa

SEQ ID NO: 31132 - DNA, 17 bp, Homo sapiens
gatccaatttgaagaag

SEQ ID NO: 31133 - DNA, 17 bp, Homo sapiens
gatctctcctgttggtt

SEQ ID NO: 31134 - DNA, 17 bp, Homo sapiens
gatcagatgcatattta

SEQ ID NO: 31135 - DNA, 17 bp, Homo sapiens
gatcatagctcgcttta

SEQ ID NO: 31136 - DNA, 17 bp, Homo sapiens
gatcatggccatttgga

SEQ ID NO: 31137 - DNA, 17 bp, Homo sapiens
gatcatattcaaacaca

SEQ ID NO: 31138 - DNA, 17 bp, Homo sapiens
gatcttgaaagccctga

SEQ ID NO: 31139 - DNA, 17 bp, Homo sapiens
gatccagagagctcaga

SEQ ID NO: 31140 - DNA, 17 bp, Homo sapiens
gatcgcccaaatcagag

SEQ ID NO: 31141 - DNA, 17 bp, Homo sapiens
gatcttcgaagtgcact

SEQ ID NO: 31142 - DNA, 17 bp, Homo sapiens
gatctatgaaatgaaac

SEQ ID NO: 31143 - DNA, 17 bp, Homo sapiens
gatcatcactttacctt

SEQ ID NO: 31144 - DNA, 17 bp, Homo sapiens
gatctgggtctcttttg

SEQ ID NO: 31145 - DNA, 17 bp, Homo sapiens
gatcaaaaataccagag

SEQ ID NO: 31146 - DNA, 17 bp, Homo sapiens
gatcacaacttgaagca

SEQ ID NO: 31147 - DNA, 17 bp, Homo sapiens
gatcctttcatttgccc

SEQ ID NO: 31148 - DNA, 17 bp, Homo sapiens
gatctgagcaatagtgt

SEQ ID NO: 31149 - DNA, 17 bp, Homo sapiens
gatcccagcaccctggg

SEQ ID NO: 31150 - DNA, 17 bp, Homo sapiens
gatctaatatgttgatt

SEQ ID NO: 31151 - DNA, 17 bp, Homo sapiens
gatcaatctgacatgaa

SEQ ID NO: 31152 - DNA, 17 bp, Homo sapiens
gatctcagatttcagcc

SEQ ID NO: 31153 - DNA, 17 bp, Homo sapiens
gatcctcctcaccccag

SEQ ID NO: 31154 - DNA, 17 bp, Homo sapiens
gatccatgtcagttttt

SEQ ID NO: 31155 - DNA, 17 bp, Homo sapiens
gatctgtgtaaaaatgt

SEQ ID NO: 31156 - DNA, 17 bp, Homo sapiens
gatcatccagaagttcc

SEQ ID NO: 31157 - DNA, 17 bp, Homo sapiens
gatccattcaccaagaa

SEQ ID NO: 31158 - DNA, 17 bp, Homo sapiens
gatccacacctcttcaa

SEQ ID NO: 31159 - DNA, 17 bp, Homo sapiens
gatctaaaaaagttatg

SEQ ID NO: 31160 - DNA, 17 bp, Homo sapiens
gatctggcttagagaca

SEQ ID NO: 31161 - DNA, 17 bp, Homo sapiens
gatcaatgcgaggacat

SEQ ID NO: 31162 - DNA, 17 bp, Homo sapiens
gatcatgaaggtgtgca

SEQ ID NO: 31163 - DNA, 17 bp, Homo sapiens
gatccacgtgcctttgt

SEQ ID NO: 31164 - DNA, 17 bp, Homo sapiens
gatcgcatggtttgagg

SEQ ID NO: 31165 - DNA, 17 bp, Homo sapiens
gatctcatgagaacaca

SEQ ID NO: 31166 - DNA, 17 bp, Homo sapiens
gatctgtacttgaccaa

SEQ ID NO: 31167 - DNA, 17 bp, Homo sapiens
gatcatcctaatctgat

SEQ ID NO: 31168 - DNA, 17 bp, Homo sapiens
gatcacctcctgaagat

SEQ ID NO: 31169 - DNA, 17 bp, Homo sapiens
gatcctatatttccttt

SEQ ID NO: 31170 - DNA, 17 bp, Homo sapiens
gatctttattttttttc

SEQ ID NO: 31171 - DNA, 17 bp, Homo sapiens
gatcaaatgggagctta

SEQ ID NO: 31172 - DNA, 17 bp, Homo sapiens
gatctgagcccaataaa

SEQ ID NO: 31173 - DNA, 17 bp, Homo sapiens
gatctggccagcttcca

SEQ ID NO: 31174 - DNA, 17 bp, Homo sapiens
gatcagccactttgaga

SEQ ID NO: 31175 - DNA, 17 bp, Homo sapiens
gatcgttggtggctctc

SEQ ID NO: 31176 - DNA, 17 bp, Homo sapiens
gatccacatttgctcag

SEQ ID NO: 31177 - DNA, 17 bp, Homo sapiens
gatctgctgcaggggca

SEQ ID NO: 31178 - DNA, 17 bp, Homo sapiens
gatcattttctggctac

SEQ ID NO: 31179 - DNA, 17 bp, Homo sapiens
gatcttgaatttctaca

SEQ ID NO: 31180 - DNA, 17 bp, Homo sapiens
gatccggcaatttttgt

SEQ ID NO: 31181 - DNA, 17 bp, Homo sapiens
gatcttataagcacaga

SEQ ID NO: 31182 - DNA, 17 bp, Homo sapiens
gatctgaatgacaaatt

SEQ ID NO: 31183 - DNA, 17 bp, Homo sapiens
gatcttctccttattat

SEQ ID NO: 31184 - DNA, 17 bp, Homo sapiens
gatctctgttcctctct

SEQ ID NO: 31185 - DNA, 17 bp, Homo sapiens
gatccttgtttaacttg

SEQ ID NO: 31186 - DNA, 17 bp, Homo sapiens
gatctacttgccttggc

SEQ ID NO: 31187 - DNA, 17 bp, Homo sapiens
gatcatttgttttcctg

SEQ ID NO: 31188 - DNA, 17 bp, Homo sapiens
gatcagaaagatgttct

SEQ ID NO: 31189 - DNA, 17 bp, Homo sapiens
gatcagacaataagaaa

SEQ ID NO: 31190 - DNA, 17 bp, Homo sapiens
gatcaaatgaagatgtc

SEQ ID NO: 31191 - DNA, 17 bp, Homo sapiens
gatcagctttccctgaa

SEQ ID NO: 31192 - DNA, 17 bp, Homo sapiens
gatcacctgagtccatg

SEQ ID NO: 31193 - DNA, 17 bp, Homo sapiens
gatcacgctcctgcact

SEQ ID NO: 31194 - DNA, 17 bp, Homo sapiens
gatctgagagctaaaaa

SEQ ID NO: 31195 - DNA, 17 bp, Homo sapiens
gatcttttcttttccaa

SEQ ID NO: 31196 - DNA, 17 bp, Homo sapiens
gatctacccgctttggc

SEQ ID NO: 31197 - DNA, 17 bp, Homo sapiens
gatcggattttgagcct

SEQ ID NO: 31198 - DNA, 17 bp, Homo sapiens
gatctcgctcccacttt

SEQ ID NO: 31199 - DNA, 17 bp, Homo sapiens
gatcactggagtgtctc

SEQ ID NO: 31200 - DNA, 17 bp, Homo sapiens
gatcttttcagggtcct

SEQ ID NO: 31201 - DNA, 17 bp, Homo sapiens
gatctctacaaaataaa

SEQ ID NO: 31202 - DNA, 17 bp, Homo sapiens
gatcttctttctcattt

SEQ ID NO: 31203 - DNA, 17 bp, Homo sapiens
gatcgatgccttctaat

SEQ ID NO: 31204 - DNA, 17 bp, Homo sapiens
gatcagactaggcaaca

SEQ ID NO: 31205 - DNA, 17 bp, Homo sapiens
gatcgacagattgacca

SEQ ID NO: 31206 - DNA, 17 bp, Homo sapiens
gatcgttcttgttctat

SEQ ID NO: 31207 - DNA, 17 bp, Homo sapiens
gatcacaatccacttgc

SEQ ID NO: 31208 - DNA, 17 bp, Homo sapiens
gatcagcctggtatgac

SEQ ID NO: 31209 - DNA, 17 bp, Homo sapiens
gatcattcatatctcaa

SEQ ID NO: 31210 - DNA, 17 bp, Homo sapiens
gatcccagctactcagc

SEQ ID NO: 31211 - DNA, 17 bp, Homo sapiens
gatctaagttcaaatcc

SEQ ID NO: 31212 - DNA, 17 bp, Homo sapiens
gatcaagggaaagcgtc

SEQ ID NO: 31213 - DNA, 17 bp, Homo sapiens
gatccccacctcagccc

SEQ ID NO: 31214 - DNA, 17 bp, Homo sapiens
gatccttttttcttttg

SEQ ID NO: 31215 - DNA, 17 bp, Homo sapiens
gatctttttcttcccag

SEQ ID NO: 31216 - DNA, 17 bp, Homo sapiens
gatcttaagtctgaaat

SEQ ID NO: 31217 - DNA, 17 bp, Homo sapiens
gatctcagtgatggtaa

SEQ ID NO: 31218 - DNA, 17 bp, Homo sapiens
gatctccaagcccagaa

SEQ ID NO: 31219 - DNA, 17 bp, Homo sapiens
gatccataaaattttat

SEQ ID NO: 31220 - DNA, 17 bp, Homo sapiens
gatccaagaggtaagaa

SEQ ID NO: 31221 - DNA, 17 bp, Homo sapiens
gatccacctggctccac

SEQ ID NO: 31222 - DNA, 17 bp, Homo sapiens
gatccactcatctctag

SEQ ID NO: 31223 - DNA, 17 bp, Homo sapiens
gatctatttttgctgat

SEQ ID NO: 31224 - DNA, 17 bp, Homo sapiens
gatctcacagaaaaagt

SEQ ID NO: 31225 - DNA, 17 bp, Homo sapiens
gatcatccttattgttt

SEQ ID NO: 31226 - DNA, 17 bp, Homo sapiens
gatctcaaatcaatgac

SEQ ID NO: 31227 - DNA, 17 bp, Homo sapiens
gatcatccactatttgg

SEQ ID NO: 31228 - DNA, 17 bp, Homo sapiens
gatcccttgagtctggg

SEQ ID NO: 31229 - DNA, 17 bp, Homo sapiens
gatcgtcacactgaatc

SEQ ID NO: 31230 - DNA, 17 bp, Homo sapiens
gatctcagcctctctga

SEQ ID NO: 31231 - DNA, 17 bp, Homo sapiens
gatctgctgtcactggg

SEQ ID NO: 31232 - DNA, 17 bp, Homo sapiens
gatcaaatgttgtgttc

SEQ ID NO: 31233 - DNA, 17 bp, Homo sapiens
gatcttcccttgccctg

SEQ ID NO: 31234 - DNA, 17 bp, Homo sapiens
gatcatacactccagcc

SEQ ID NO: 31235 - DNA, 17 bp, Homo sapiens
gatcgggctccagagat

SEQ ID NO: 31236 - DNA, 17 bp, Homo sapiens
gatctgagaactctaca

SEQ ID NO: 31237 - DNA, 17 bp, Homo sapiens
gatctttattactggca

SEQ ID NO: 31238 - DNA, 17 bp, Homo sapiens
gatcccattttcctctc

SEQ ID NO: 31239 - DNA, 17 bp, Homo sapiens
gatctaagtcttctgtt

SEQ ID NO: 31240 - DNA, 17 bp, Homo sapiens
gatctgctagtaaaaac

SEQ ID NO: 31241 - DNA, 17 bp, Homo sapiens
gatcgcggattttggaa

SEQ ID NO: 31242 - DNA, 17 bp, Homo sapiens
gatcttcattttccttg

SEQ ID NO: 31243 - DNA, 17 bp, Homo sapiens
gatcaattattttcagc

SEQ ID NO: 31244 - DNA, 17 bp, Homo sapiens
gatcctcagaatcaact

SEQ ID NO: 31245 - DNA, 17 bp, Homo sapiens
gatccacccagttacag

SEQ ID NO: 31246 - DNA, 17 bp, Homo sapiens
gatctaataatactcac

SEQ ID NO: 31247 - DNA, 17 bp, Homo sapiens
gatctccaagtctcaac

SEQ ID NO: 31248 - DNA, 17 bp, Homo sapiens
gatctgtttttaaaatc

SEQ ID NO: 31249 - DNA, 17 bp, Homo sapiens
gatctgttgcagtctcc

SEQ ID NO: 31250 - DNA, 17 bp, Homo sapiens
gatcactagggtcttat

SEQ ID NO: 31251 - DNA, 17 bp, Homo sapiens
gatcttccttttcctcc

SEQ ID NO: 31252 - DNA, 17 bp, Homo sapiens
gatcttttgttgtttcc

SEQ ID NO: 31253 - DNA, 17 bp, Homo sapiens
gatctactacatcccac

SEQ ID NO: 31254 - DNA, 17 bp, Homo sapiens
gatctgattttttattc

SEQ ID NO: 31255 - DNA, 17 bp, Homo sapiens
gatctggcagaacgcac

SEQ ID NO: 31256 - DNA, 17 bp, Homo sapiens
gatctggtacaatggag

SEQ ID NO: 31257 - DNA, 17 bp, Homo sapiens
gatcaggccaccacact

SEQ ID NO: 31258 - DNA, 17 bp, Homo sapiens
gatcgtgtgcattacag

SEQ ID NO: 31259 - DNA, 17 bp, Homo sapiens
gatctcggtctctctct

SEQ ID NO: 31260 - DNA, 17 bp, Homo sapiens
gatccacagcagcccga

SEQ ID NO: 31261 - DNA, 17 bp, Homo sapiens
gatctactctctattgt

SEQ ID NO: 31262 - DNA, 17 bp, Homo sapiens
gatcccattttctttct

SEQ ID NO: 31263 - DNA, 17 bp, Homo sapiens
gatctgcaaagatacac

SEQ ID NO: 31264 - DNA, 17 bp, Homo sapiens
gatcttttatgtgtttt

SEQ ID NO: 31265 - DNA, 17 bp, Homo sapiens
gatcctcttcccccagg

SEQ ID NO: 31266 - DNA, 17 bp, Homo sapiens
gatctaccgtagtatcc

SEQ ID NO: 31267 - DNA, 17 bp, Homo sapiens
gatctgaaagaaaaatc

SEQ ID NO: 31268 - DNA, 17 bp, Homo sapiens
gatcactacactctttc

SEQ ID NO: 31269 - DNA, 17 bp, Homo sapiens
gatccttttaaaaatat

SEQ ID NO: 31270 - DNA, 17 bp, Homo sapiens
gatctcattatgactca

SEQ ID NO: 31271 - DNA, 17 bp, Homo sapiens
gatctgttagatgtgaa

SEQ ID NO: 31272 - DNA, 17 bp, Homo sapiens
gatctcataatattgga

SEQ ID NO: 31273 - DNA, 17 bp, Homo sapiens
gatcatttgttctcctg

SEQ ID NO: 31274 - DNA, 17 bp, Homo sapiens
gatcctgttcatccata

SEQ ID NO: 31275 - DNA, 17 bp, Homo sapiens
gatcggtttctcgcagc

SEQ ID NO: 31276 - DNA, 17 bp, Homo sapiens
gatctcttgggcccacg

SEQ ID NO: 31277 - DNA, 17 bp, Homo sapiens
gatcaaaaaggcatttg

SEQ ID NO: 31278 - DNA, 17 bp, Homo sapiens
gatcactgcctttcccc

SEQ ID NO: 31279 - DNA, 17 bp, Homo sapiens
gatctcaaatatgttgg

SEQ ID NO: 31280 - DNA, 17 bp, Homo sapiens
gatctgatagcagtcat

SEQ ID NO: 31281 - DNA, 17 bp, Homo sapiens
gatccgctgcagagatg

SEQ ID NO: 31282 - DNA, 17 bp, Homo sapiens
gatcctttgttgataaa

SEQ ID NO: 31283 - DNA, 17 bp, Homo sapiens
gatctacccgccttggt

SEQ ID NO: 31284 - DNA, 17 bp, Homo sapiens
gatccacatggtctctt

SEQ ID NO: 31285 - DNA, 17 bp, Homo sapiens
gatcctttctcataaag

SEQ ID NO: 31286 - DNA, 17 bp, Homo sapiens
gatcctgatgtctgcct

SEQ ID NO: 31287 - DNA, 17 bp, Homo sapiens
gatctacctacacacgg

SEQ ID NO: 31288 - DNA, 17 bp, Homo sapiens
gatcaagcctctgtgcc

SEQ ID NO: 31289 - DNA, 17 bp, Homo sapiens
gatcgaccagtttgtcc

SEQ ID NO: 31290 - DNA, 17 bp, Homo sapiens
gatcgccagagatgagt

SEQ ID NO: 31291 - DNA, 17 bp, Homo sapiens
gatccctttgaactcat

SEQ ID NO: 31292 - DNA, 17 bp, Homo sapiens
gatccttctcacagatg

SEQ ID NO: 31293 - DNA, 17 bp, Homo sapiens
gatcctgccttattaag

SEQ ID NO: 31294 - DNA, 17 bp, Homo sapiens
gatctaaaaaactctca

SEQ ID NO: 31295 - DNA, 17 bp, Homo sapiens
gatccagctgggtctta

SEQ ID NO: 31296 - DNA, 17 bp, Homo sapiens
gatcaccttagcccagg

SEQ ID NO: 31297 - DNA, 17 bp, Homo sapiens
gatcaaagaggatatca

SEQ ID NO: 31298 - DNA, 17 bp, Homo sapiens
gatcaagtgaaccatcc

SEQ ID NO: 31299 - DNA, 17 bp, Homo sapiens
gatcagttttattactt

SEQ ID NO: 31300 - DNA, 17 bp, Homo sapiens
gatcaccctgattcagt

SEQ ID NO: 31301 - DNA, 17 bp, Homo sapiens
gatcctctgaaatcctt

SEQ ID NO: 31302 - DNA, 17 bp, Homo sapiens
gatctgctatttcttgg

SEQ ID NO: 31303 - DNA, 17 bp, Homo sapiens
gatcatattgaaattga

SEQ ID NO: 31304 - DNA, 17 bp, Homo sapiens
gatcaataacaacaaat

SEQ ID NO: 31305 - DNA, 17 bp, Homo sapiens
gatcaggccttttaact

SEQ ID NO: 31306 - DNA, 17 bp, Homo sapiens
gatcattctcctgtatc

SEQ ID NO: 31307 - DNA, 17 bp, Homo sapiens
gatcactgggaagctta

SEQ ID NO: 31308 - DNA, 17 bp, Homo sapiens
gatccctttacaaaaag

SEQ ID NO: 31309 - DNA, 17 bp, Homo sapiens
gatcactttctactttg

SEQ ID NO: 31310 - DNA, 17 bp, Homo sapiens
gatctctttcctttttt

SEQ ID NO: 31311 - DNA, 17 bp, Homo sapiens
gatctctccactcaccg

SEQ ID NO: 31312 - DNA, 17 bp, Homo sapiens
gatcacatattctagtg

SEQ ID NO: 31313 - DNA, 17 bp, Homo sapiens
gatcacctgacgtcagt

SEQ ID NO: 31314 - DNA, 17 bp, Homo sapiens
gatctgtcttgatgtgt

SEQ ID NO: 31315 - DNA, 17 bp, Homo sapiens
gatctggtggaatggat

SEQ ID NO: 31316 - DNA, 17 bp, Homo sapiens
gatctgttggtgacgaa

SEQ ID NO: 31317 - DNA, 17 bp, Homo sapiens
gatctgtctcttgtcag

SEQ ID NO: 31318 - DNA, 17 bp, Homo sapiens
gatcttgctctgctgtt

SEQ ID NO: 31319 - DNA, 17 bp, Homo sapiens
gatcggttgccattgtg

SEQ ID NO: 31320 - DNA, 17 bp, Homo sapiens
gatctgcgagaaagcac

SEQ ID NO: 31321 - DNA, 17 bp, Homo sapiens
gatcatgtgtttttcac

SEQ ID NO: 31322 - DNA, 17 bp, Homo sapiens
gatcctcctgtatcagc

SEQ ID NO: 31323 - DNA, 17 bp, Homo sapiens
gatcctttttttgtttg

SEQ ID NO: 31324 - DNA, 17 bp, Homo sapiens
gatctcctaaaatagta

SEQ ID NO: 31325 - DNA, 17 bp, Homo sapiens
gatctggcatttgtatt

SEQ ID NO: 31326 - DNA, 17 bp, Homo sapiens
gatctcaacaggaattt

SEQ ID NO: 31327 - DNA, 17 bp, Homo sapiens
gatctactttattattc

SEQ ID NO: 31328 - DNA, 17 bp, Homo sapiens
gatcgagccagtgagtc

SEQ ID NO: 31329 - DNA, 17 bp, Homo sapiens
gatcatgggaggcttga

SEQ ID NO: 31330 - DNA, 17 bp, Homo sapiens
gatcttacaaagaaact

SEQ ID NO: 31331 - DNA, 17 bp, Homo sapiens
gatccaggcatacgtgt

SEQ ID NO: 31332 - DNA, 17 bp, Homo sapiens
gatcctgccagttttac

SEQ ID NO: 31333 - DNA, 17 bp, Homo sapiens
gatcccaagccaggacc

SEQ ID NO: 31334 - DNA, 17 bp, Homo sapiens
gatcagatttgaacact

SEQ ID NO: 31335 - DNA, 17 bp, Homo sapiens
gatcatatcccatatct

SEQ ID NO: 31336 - DNA, 17 bp, Homo sapiens
gatcttaaaaacttctt

SEQ ID NO: 31337 - DNA, 17 bp, Homo sapiens
gatcaagatatttggca

SEQ ID NO: 31338 - DNA, 17 bp, Homo sapiens
gatctggctaagcatct

SEQ ID NO: 31339 - DNA, 17 bp, Homo sapiens
gatcacttggacccagg

SEQ ID NO: 31340 - DNA, 17 bp, Homo sapiens
gatcacctggagctatt

SEQ ID NO: 31341 - DNA, 17 bp, Homo sapiens
gatcaagagtttattta

SEQ ID NO: 31342 - DNA, 17 bp, Homo sapiens
gatccctttgatttgaa

SEQ ID NO: 31343 - DNA, 17 bp, Homo sapiens
gatcagatttatcatat

SEQ ID NO: 31344 - DNA, 17 bp, Homo sapiens
gatcattacacatgtat

SEQ ID NO: 31345 - DNA, 17 bp, Homo sapiens
gatcttctgatgctgag

SEQ ID NO: 31346 - DNA, 17 bp, Homo sapiens
gatcgtgtaacatcctt

SEQ ID NO: 31347 - DNA, 17 bp, Homo sapiens
gatctcagctccttgcc

SEQ ID NO: 31348 - DNA, 17 bp, Homo sapiens
gatccaatgcctttttt

SEQ ID NO: 31349 - DNA, 17208 bp, Homo sapiens
ggactgagagcagggagcagcaggcatggggcatgccgggtgccagttcaaagccctgctgtggaagaattggctctgcagactcaggaacccggtccttttccttgctgaattcttctggccttgtatcctgtttgtaattctgacagttcttcgttttcaagaacctcccagatacagagacatttgttatttgcagccccgagatctacccagctgtggtgttatcccctttgttcaaagccttctttgtaacactggatcaaggtgtaggaacttcagctatgaagggtcaatggagcatcattttcgtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccagattcttcttatggttccagtttttttacaatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaattccttaatatccctagaagatttagattggcttccactcaaccaaactttttcccaggtttctgaacttgtactgaatgtgaccatttcgacactgacatttctgcagcaacatggagtagcagtcaccgagccagtttaccacctgtccatgcagaatatagtgtgggatccacagaaagtccagtatgatctcaaatcccagtttggctttgatgatcttcacacggaacagatcctgaactcttcagctgaactgaaggagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatattacagcatctgtggaaattgcaaagcttgctgcaaaacctgccccagtggccggcactgaagagatttcttcagcttgatggagctctcagaaatgcgatagctcagaatttacattttgtccaagaagtcctcatttgcctggagacatcagctaatgattttaaatggtttgaacttaaccaattgaaactggaaaaggatgtgttcttttgggagctgaaacagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgatatttcatacacttgaaaaaacacaatttttcctggaacaagcatattattggaaagccttcaaaaagtttatcaggaagacttgcgaagtggcccaatatgtaaatatgcaagagagtttccagaacagactattggcttttcctgaggaatctccttgttttgaagaaaacatggattggaaaatgatcagtgataattattttcaatttttgaataacttactcaagtctccaacagcttccatatccagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgtaaattattcaacaagtgaggagtcttcatttgtttttccattggcacaaattttttcaaacctctcagcaaatgtcagtgtgttcaacaagtttatgtccattcactgtaccgtttcatggcttcaaatgtggactgaaatctgggaaaccatatctcaattatttaagtttgacatgaatgttttcacatctcttcatcatggtttcactcagcttttggatgaattggaagatgatgtgaaagtctctaaaagctgccagggtatacttcccacccataatgttgctagactcatattaaatttgtttaaaaatgtaactcaagccaatgacttccataattgggaggacttcctggatctcagggattttttggtagctttaggtaatgcattagtttcagtaaaaaaacttaacttggagcaagtggagaaatcccttttcaccatggaagctgccctgcatcagttgaagacatttccattcaacgaaagtacaagcagagagtttttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaaaacctctttgttcatcaaatggctcacatataaattgtgtcaatatttacttgaaagatgtaactgactttctaaatattgtacttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaggcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgagttttgtcccaaaagataaaattctagaaattctgaaactggatcaatttcttaccctgatgatacaagacagattgatgaacattttttcaagtttaaaggagactatatatcacctaatgaaaagttcatttatattagacaatggagaattttattttgatactcatcaaggactgaagttcatgcaagatttatttaatgcccttctcagggaaacttcaatgaaaaataagactgaaaataatatagactttttcacagtggtgagtcagttgtttttccatgtgaataagtctgaggacctcttcaaactcaatcaagatcttgggtcagctcttcaccttgtaagagaatgttcaacagagatggcaagacttctggatacaattttacactctcctaataaggacttctatgctttgtatcctaccctccaagaagttatacttgctaatctaacggatttgcttttctttataaataattcattccctctaagaaacagagcaacattagaaattactaagagattagttggtgctatttcaagagcaagtgaagaaagtcacgtcctgaaacccctcttagaaatgtctgggactctggtcatgctgttgaatgacagtgctgacctgagagatcttgccacatcaatggactccattgtgaaacttcttaagctggtcaagaaagtttcggggaagatgtccacagtttttaaaactcattttatctccaataccaaggacagtgtgaaattctttgacactctgtattccatcatgcaacaaagtgttcaaaatcttgtgaaagaaatagctactttaaaaaaaatagatcatttcacatttgaaaagataaatgatttgttggtgccatttcttgacttggcctttgaaatgattggggtagaaccttatatatcatcaaactctgatattttcagtatgtcacctagcatactctcatatatgaaccaatctaaggacttttctgatattttggaagaaattgctgaatttttaacatctgtgaaaatgaacttggaagatatgaggagtcttgcggtagcatttaacaatgagactcaaacattttctatggattctgtcaacttacgggaagaaattctgggttgcttagttcctataaataacatcaccaaccaaatggacttcttataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaagtgttgttgagatttgtgaagttttccagcagactgtgaagccctcagaagccatggagatgctgcagaaagtgaagatgatggtcgtacgtgtgctcaccatcgttgcagaaaacccttcctggaccaaggacattttgtgtgctactctgagttgcaagcaaaatgggataaggcatctcattttatctgctatacaaggggtcactttggcgcaggaccacttccaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgttggccaaaagcctcgaggaaacttggtcatcagggaatcccatcatgacttttctcagcaatttcacagtaactgaggatgtaaaaataaaagatttgatgaagaatatcaccaagttgactgaggagcttcgctcttccatccaaatctcgaatgagactatccatagcattctagaagcaaatatttcccactccaaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaacaccgttttgcttgaagctttatcaggaaattctacaattgccaaatggtgctttggtgtggaccttcctaaaacccatattgcatggaaaaatactatacacaccaaacactccagaaattaacaaggtcattcaaaaggctaattacaccttttatattgtggacaaactaaaaactttatcagaaacactgctggaaatgtccagccttttccagagaagtggaagtggccagatgttcaaccagctgcaggaggccctgagaaacaaatttgtaagaaactttgtagaaaaccagttgcacattgatgtagacaaacttactgaaaaactccagacatacggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctattcctgaacaacgttggtttcttttttccactgataatgatgctgacgtggatggtgtctgtggccagcatggtcagaaagttggtgtatgagcaggagatacagatagaagagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctgtgccttctttcgacaaccgcctttggacaaggggtattttttattacattcctggaaggacaagagacagggattcaatggaataatatgtaccaggctctggaacaagggggcatgacatttggctgggtttgctggatgattctttttgattcaagcctttattttttgtgtggatggtacttgagcaacttgattcctggaacatttggtttacggaaaccatggtatttcccctttactgcctcatattggaagagtgtgggtttcttggtggagaaaaggcaatactttctaagttctagtctgttcttcttcaatgagaactttgacaataaagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcaaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtgtttttgatgcttttgcaagattccaacaagaaatctcacattgccctggggactgagtcagagctgcagaaccacaggcctacaggacatctgtctggctactgtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcagcagtgggggcgacaacttggacctcacccgtgtgcttctgcggaagtttagagatcaagatttgccctgtgcagatttaaacccacgccagaagaattcttcatgctggcgcacagatcccttttctcacccagaattccaggattcatgtggctgcctgaagtgtccaaatagaagtgctagtgctccctacctgaccaaccacctgggccacacactgttgaatctctcaggcttcaatatggaggagtacttgctggcaccatctgaaaaaccaaggcttggaggttggtcttttggattaaaaatccccagtgaagctggaggtgcaaatggaaacatatcaaaacccccaactctggcaaaggtgtggtataatcagaagggttttcattccctaccttcctacttaaatcatctaaacaaccttattttgtggcagcacctaccccctactgtggactggagacaatacggaataacactctacagccacccatatggaggggccttgctgaacaaggacaagatcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaacccaaaaaaaaaaaaaaaaaaaaaaa

SEQ ID NO: 31350 - DNA, 2858 bp, Homo sapiens
gccaggagcccgatcgagatgatgatggttatgcagcccgagggtctgggggccggggaggggcgctttgcgggcggcggcgggggcggcgagtacatggaacaggaggaggactgggaccgcgacctgctgctggacccggcctgggagaagcagcagcggaaaaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgcttctgtggtgccagaggaagacagcaccgtaccgcaacgtcaacgtgcagaacttccacaccagctggaaggatggcctggccctctgtgccctcatccaccgacaccgccctgacctcatcgactacgccaaactgcgaaaggatgaccccatcggaaacctgaacactgcctttgaggtggcagagaaatacctggacatccccaagatgttggatgcagaagacattgtgaacaccccaaagccggatgagaaggccatcatgacctatgtgtcctgcttctaccatgcctttgccggggctgagcaggcagagacagctgccaacaggatctgcaaggtgctggcagtgaaccaggaaaacgagaagctgatggaggagtatgagaagcttgccagtgagctgctggagtggatccgccgcactgtcccatggctggagaaccgtgtgggtgagcccagcatgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggtctcggacatcgccaacgcctggcgggggctggagcaggtggaaaagggctatgaggactggctgctctcggagatccggcgcctgcagcgactccagcacctggctgagaagttccggcagaaggcctccctgcacgaagcctggacccggggaaaggaggagatgctgagccagcgcgactacgattcggctttgctacaggaggtgcgggcgttgctgcggcgccacgaggcctttgagagcgacctggcggcgcaccaggaccgcgtggagcacattgccgcgctggcccaggagctcaatgagctggactaccacgaggcagcctcagtgaatagccgctgccaggccatctgcgatcagtgggacaacctgggcaccctgacccagaagaggcgggatgcgctagagcggatggagaagctcctggagaccattgaccagctgcaactggagtttgcccggcgggccgcgcccttcaacaactggctggatggtgccgtggaggacctgcaggacgtgtggctggtacactctgtggaggagacccagagcctgctgacagcgcacgatcagttcaaggcaacactgcccgaggctgaccgagagcgaggtgccatcatgggcatccagggtgagatccagaagatctgccagacgtatgggctgcggccctgctccaccaatccctacatcaccctcagcccgcaggacatcaacaccaagtgggatatggtccgaaagctggtgcccagccgtgaccagacactgcaggaggagctggcacggcagcaggtaaacgagaggctccggcgacagtttgcggcccaggccaatgccattggaccctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcggaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtca

SEQ ID NO: 31351 - DNA, 4063 bp, Homo sapiens
gtggctcgcggctcaggctgcccccgacgtgcccggctcaccgccccctcccctgcagccccgcccgccatggcccggatcccgacggccgccctgggttgcatcagcctcctctgcctgcagctccctggctcgctgtcccgcagcctgggcggggacccgcgacccgtcaaacccagggagcccccagcccggagcccttccagcagcctgcagcccaggcaccccgcaccccgacctgtggtctggaagcttcaccgggccctccaggcacagaggggtgccggcctggcccctgttatgggtcagcctctccgggatggtggccgccaacactcgggcccccgaagacactcgggcccccgcaggacccaagcccagctcctgcgagtgggctgtgtgctgggcacctgccaggtgcagaatctcagccaccgcctgtggcaactcatgggaccggccggccggcaggactcagctcctgtggaccccagcagcccccacagctatggctgaggtggggccgggccacacccctgcccatcccagccagggtgctgtgcccccgtccagagctgcagctgagccccatctgaagcccagtccctcggagctgcagacagcaggtcctgcagcaacaatacctgcacggctttgcacacgtaaacctaggctggtctacacgcagtgctggtacgtcaaggagcctaaacaccctgaaattgtgaccccctgggggacagctgccagacacagctggcggcagcaccagatgctaagcgcttcagagaggaggtgtctgcccagagatgtggagcagaagctgggccctgaacacacggggccatgtctggacgagcaggggagagaggctgaactggccagaagtggcccctccgctgctggtccagtcagactgaagcccggccttgtgcctgggctgttcctgctctcatgcacaaccagcccttccacgtgcctgcctgtgggacaggagggggagcgtgggatgctgtagcccccggggttgggcaagggaaggatggtggccctccagaggtcatgaagggacctctgtggctccagctgccaaccctggagcccagaccgaggtggccatggagactccacctggatcccctgtaggaggccagggaggggaactcagcagttcaggagccaccccaaaccattctgggacagggacacccctttctaccccagggcagggcagggctgggtggggcaagatcccccagcccgactagacccacctcacctgaagggggtgagacccttgttggcagccagacaagggtggggctccacaggcagcacaggcgccccaccaccacccagtttggggacccagtgggaccaggtgcgggggcagagggtgacttaccaagagccagggagggcagcccaggcccaagtgacagcaagaacaagaaccactgccggcgtgcacagacttggtgtgtgtccttccctggggggacgggggactcacatgtgcctgccactggagcctctcaaccgtccagcagaacacggggttcagaaagggctccttctgctatttagcgaacactgagcatttaatttacaaatgtttgctagggtcaccctctcggccatcccacgagggtcgccatgatcaccccaactctagaggccgcagcagagctcaggacattcccccacagagcttgcccctcagttcctacctccaagggggagggtcctggaagcgcccacccaggcgccgcccctgtgcttgctccccgagctcagggattgccgagtccacgtaactgacctgtactccacgaggccctgtgggaacggtccaggctggtcctgccctgtggaggcctccgtgcactgagagatgtactaggattgcagcaaaggtggtcagggtgatgggccgcacagcgaggcagtcaaggccagctccctgggagaagcactgggtcaggtgaggtctgaggacagcaggccttccctaggggaaggagctgggagtgccaaggccccaggtgcacaggaggcgtggctgctgagaggctgcagggtggaggggcctcggcctcagagtcatgtgccctgtgaccactgaagggtgtcagcagagcacacggcatgaggacagagggaggggcacggggagtgaaggagggggccctggggcaaggctcgggggtcaggagctcagcgtccgctactcagcccagccaaaaccctcccagacgtctcctctcctgcctgggcaaagtccagcttggcaccccgtctggggcctgcctgtggtcagggccaagtgttccctcctccaggaaagcctttaccctcctcatgccctgtagtcaggaggccgcctgctgtaaccctccgtgtcgcctcgggtgcgaaatcagacccacctgacaccatcacgcggaggcccagcagcacctgcacccacttccagctgctctggccaaaatctccgctcggccaggccccgtggctcacacctgtaatcctagcacattgggaggccaaggcaggcacatcacctgagttcaggagttcaagaccagcctggccaacatggtgaaatcccgtctctactaaaaacagaaaattatccgggcgtggtggcacatgactgtaatcccagctactcaggaggctgaggcaggaggatcacttgaacctgggaggcggaggttgcagtgagctgagattgcgccattgcactccagcctgggcaacaagagcaaaattctgcctcaaaaaaaaaaatagtaataatacaaaaattagctgggcgtggtggcacatgccagtaattccatctactcgggaggctgaggcaggagaatcgtctaagcccgggaggtggaggttgcagtgagcccagatggcgctgctgcactcaagcttggatgacagagcaagactccgtttcaaaaaaaaaaaacctcctctcttccttcacaccttcctctgaatcccacccggtcccacctcctgaacctatccagacaccttctcctgacccaggcaccacctgctttcggggcgatggccgtagcctcctcccaggcacctgtctgcatccctctggccagtgcatgctgagcacgtgacctacccgtgttgggacacgtgaggatacagccttgacccccaggggctgacattctagggggagatagaaggagacaaacgtagaaggtagaataagtgggtggtggagtggcagggagtgctgagtgccacaggaagtcagacaaggaaggagagtgtggggcaggtgccgtttaaatggggggcgctggggtctcctcacagttgcttctcagctcagctgtgccaggatcttgttgagtcaggtcagctgcccacagccctcttgcctgacccctgaagcccagaactctgatcttcacagccctaggtatggccccagcaccccactgccctctctcctgccccagccgactgctgttcccagacttccctggccacgctccaagacgccagctctgccgcgggcactttgttctcacggtgtcctccatgcctgcagggcccatgcatgggaagttgcgttggcggcctgggtgttggcggttccgtgcctgctccaactctccgtgaggcccctctcccagagcctgacacactctgtggccgaactctaggcaggtgcccctgagtcctttcctcgacgaggcctgaccccatccccatcctcgctgggcccgccgaccccggtgttagcaagaatcctctaaatcagtttatggagaattacccaccctcgatatctgatcccattcctcatctcccacccttgatctcatcaccctgccggcctcctgcaagatcctcattgagccactccagtgagaatccccctaccctcgaaggccgccctaacaacttcccatccgctgacccctccaacgccatcaatctccagctgtggttgttgaactcggaggtgagctcctctcaccactctcttgaataaagcttttctcaccattttaaaaaaaaaaaaaaa

SEQ ID NO: 31352 - DNA, 5319 bp, Homo sapiens
ggctgggctgcgaatagcgtgttcctctccggcggaacacacacacccggccttggggctgtctcctgaagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggcggcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccaccgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagttggagttgtatgatcttcagatcttaggcacaaaaccaccgatgaattccgatacacatcgtaactttgaccccaccgcaacccttagaaatcagggtgatttcacctggaacagcatgtcaggccgcagtgtgcggctgaggtcagtccccatccagagtctctcagagctggagagggcccggctgcaggaagtgcctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaacaagttctgtgcttccggctgcagtgcaggcctgcccacagtaccctgccagcatgtttacgccctgacctggagggaccagctaaggaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacattggtaaaaggcctacagctttgtacttacattgtgccaaaggctgaggaaatgttttctttcgaatttttatgtgtattgtaaaatgttctaccgtactttagtagtttgaagttttcaagtgcataactatttttgaccagcagaaggcgatacgcttcagtattttatgcaattttttttcacttcgaagggaaagtgtattataaaaaaagattttttttttttaaaacatgctactcttaattttcatgttggtgatgaaattcccagtggtgtttcttaaggttctatcttgtgccatgatgaataaaaagttaagcaaaaaaaaaaaaaaaaaaaaaaaaa

SEQ ID NO: 31353 - DNA, 3633 bp, Homo sapiens
ggctgggctgcgaatagcgtgttcctctccggcggaacacacacacccggccttggggctgtctcctgaagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggcggcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccaccgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagggtgatttcacctggaacagcatgtcaggccgcagtgtgcggctgaggtcagtccccatccagagtctctcagagctggagagggcccggctgcaggaagtgcctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataac

SEQ ID NO: 31354 - DNA, 2267 bp, Homo sapiens
ttggagttgtatgatcttcagatcttaggcacaaaaccaccgatgaattccgatacacatcgtaactttgaccccaccgcaacccttagaaatcagggtgatttcacctggaacagcatgtcaggccgcagtgtgcggctgaggtcagtccccatccagagtctctcagagctggagagggcccggctgcaggaagtgcctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataac

SEQ ID NO: 31355 - DNA, 3961 bp, Homo sapiens
gcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatggggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacattggtaaaaggcctacagctttgtacttacattgtgccaaaggctgaggaaatgttttctttcgaatttttatgtgtattgtaaaatgttctaccgtactttagtagtttgaagttttcaagtgcataactatttttgaccagcagaaggcgatacgcttcagtattttatgcaattttttttcacttcgaagggaaagtgtattataaaaaaagattttttttttttaaaacatgctactcttaattttcatgttggtgatgaaattcccagtggtgtttcttaaggttctatcttgtgccatgatgaataaaaagttaagcaaaaaaaaaaaaaaaaaaaaaaaaa

SEQ ID NO: 31356 - DNA, 5133 bp, Homo sapiens
ggctgggctgcgaatagcgtgttcctctccggcggaacacacacacccggccttggggctgtctcctgaagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggcggcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccaccgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagggtgatttcacctggaacagcatgtcaggccgcagtgtgcggctgaggtcagtccccatccagagtctctcagagctggagagggcccggctgcaggaagtgcctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacattggtaaaaggcctacagctttgtacttacattgtgccaaaggctgaggaaatgttttctttcgaatttttatgtgtattgtaaaatgttctaccgtactttagtagtttgaagttttcaagtgcataactatttttgaccagcagaaggcgatacgcttcagtattttatgcaattttttttcacttcgaagggaaagtgtattataaaaaaagattttttttttttaaaacatgctactcttaattttcatgttggtgatgaaattcccagtggtgtttcttaaggttctatcttgtgccatgatgaataaaaagttaagcaaaaaaaaaaaaaaaaaaaaaaaaa

SEQ ID NO: 31357 - DNA, 3857 bp, Homo sapiens
ctccagaactctcacccgattgcctgcctctgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggcctgatcttactcatttacttcttcttctatgcctccttggctgctgtgatcaccctctgcatgtacacactatttctgaccatcagtccctatataccaaccttcacggagcgggtaaagcctcctggagttatgatcagacccttcgcccatagccttaacttcaacttcaacgtttctgaacccgacacttggcagcattatgtgattagcctaaatggctttctccagggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccggattgtaggctttcgtcctgagcttggagatcctgtgaaggtttcctgcaaagttcagagaggtgatgaaaatgacatccgatccatcagttactacccagagtcggcttcttttgacctccgctactacccttactacggcaaactgactcacgttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttaccagttctgtttctgttttatctcatggtatctctggtagcacctgaattctttttcttcaattaggacacagccagatggacatctaagacagccgatcatctttccttgcctatgacatgtgtataaaatgacattgtgggagctgttcgattttttaaaggtagtgtctcctgatgacaaacagagtatattaatttcctttccctccacttaaaactaaagcctgttcttgctgctggtaatctccctgtagcgtaaacatagtatctgataaaatttacaatagccacgcaatagccatcaaggagaatttctattatgattataaattcatcatgttttctaaaattctgttggttttagaggtcagattcctcccaaccaggctaataacctaacacatgtttaaaaaaaatctgcctaagccgggtgtggtggcatgcatctgtagtcccacctattcaggagattaaggcaggaggatcacttgagcccaggaggtcaaggctgcagtgagctgcactgcattccagcctgggtgacagagtgagatcctgtctctgaagaaaaaaaaaacctgcctggcaaggtccttccctgggaatcaccactcggtccaacctagacaaccaagaccgctatacctaaagacctctatatcctggtgcctaagaaacttctgcctcccacagacaactaagtgcttattcaaagactaggttattttcaactgggaaaaaagcagtgctaacaggatattgttctgggatagagatgaagaccgtccttgtgactttttaaagaggtggggctcactgcaactggggagaacacttagcatatggatatgattggtgtttgattccttgctctctggtgtaatcgtctaaaggcaaacattcctgcaaacaggtttttctcagcttcaggcagaggagacaacatggaagaagattcccaccagctaattcttcttgggctatttgtttgacagtagcatgatgttttttgagaccatcaggggtggttacatagaccagcagctacagctctggaaattgaaatcataatctgtcaatgaatacatgacaagacagaacgttccttgccaggccaggcaaaagccaaggcccattagccagtttagcatttactttaaaaatgacatgaggcagattcttatccaggatgtggatcagccaggtcactttgtcttatctttggtcacctgatcactcaactgcttcttaacacctccaccagggggaaggctggcacaaggagaaaaaaaaagcaagcatcagcgaatagtatagtgtctcagggtccgaagcaagtttaaatgccacctaggaggatccaaagtctgaatctcctctacaatgtttcctttctcccaaaaccagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatgggcaataaggaaggaggagtttggagaatgactccaaaggtttgagcttggctagaaccggtaagatggtgacattgttgatcaagactgggaatataagagagaagcagatttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgggaactgaagccagtcatgtaaacatactataccaatctagtccctaacagtgttttttctcttgtggcagaaagaattgctgttcctctttggaatctccttcccagacaccttcaaagtcttattgacacagtaaagggaggccaaccactactaacaagttctagaagatataggatcttctatagtaggttaatggaaaatacaaaaacaaacaaacatacaatgaaactgcctcctctcaacccattttcttaacaaattcaattttcaaaa

SEQ ID NO: 31358 - DNA, 4080 bp, Homo sapiens
gcgcctgcggcgccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacagctccccttggctcatcattcagatggctttccagatgaccaggacaggtgggatattttgcccccaacttggctcggcatgtgaattcttagctctgcaaggtgtttatgcctttgcgggtttcttgatgtgttcgcagtgtcacccaagagtcagaactgtagacatcccaaaatttggtggccgtggaacacattcccggtgatagaattgctaaattgtcgtgaaataggttagaatttttctttaaattatggttttcttattcgcgaaaattcggagagtgctgctaaaattggattggtgtcatctttttggtagttgtaatttaacagaaaaacacaaaatttcaaccattcttaatgttacgtcctccccccacccccttctttcagtggtatgcaaccactgcaatcaatgtgtcatatgtcttttcttagcaaaaggatttaaaacttgagccctggaccttttgcctatgtgtgtggattccagggcaactctagcatcagagcaaaagccttgggtttctcgcattcagtggcctatctccagattgtctgatttctgaatgtaaagttgttgtgtttttttttaaatagtaggtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctaagtatttttattctggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgcacccacaccccaactccctcccaagaacttcggtcctaaagcctcctgttccacctcaggttttcacaggtgctcacaccacagttgaggctcacacacaggtctgtctgtcacaaacccacctctgttgggagctattgagccacctgggatgagatgacacaagacactcctaccactgagcgcctttgtccaggtgccagcctgggctcaggttccaagactcagctgcctaatcccagggttgagccttgtgctcgtgtcggaccccaaaccactgccctcctggtaccagccctcagtgtggaggctgagctggtgcctggccccagtcttatctgtgcctttactgctttgcgcatctcagatgctaacttggttctttttccagaaggctttgtattggttaaaaattattttctattgcagagagcagctgtgactcatgcaaaaagtattttctctgtcagatccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgtttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgtaccgcgaagtgtgtcatgtgccgtgcccttttctgtttctgtgtatcctattgctggtgactctgtgtgaactggcctttgggaaagatcagagaggcagaggtggcacaggacagtaaaggagatgctgtgctgcctacagcctggacagggtctctgctgtactgccaggggcgggggctctgcatagccaggatgacgcctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctaactttgt

SEQ ID NO: 31359 - DNA, 4225 bp, Homo sapiens
ggagtcgcggctgcgagcaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgaccgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccgggtgccaagctgttctacctttctggaatggtgcatggagaatatcaaaaccaagaaatccacaatctgggccgttttattacagttatgaagtttaggcctctcacatggcaaacttctcacccttatatcctggcagacaggatggaagatttgacaaacccagaggatatccgaacaaacatcaaatgtgaccggaaggtgtcactttatggttatttaagaggagcacacttgaaaaataaaagccaaattcacatgccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggatgaagtggggcccacccatgagctggtccagagtctcatctctacccactccaccattgatgccaagatggcttcaagtcgagtgacgctgttttctgattccaagccacttgggtcagaggatatagataatcaagggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtgccctcaagtggaaggaagacctttccagaaaggcagctgaggcctttctgaggcagcagcaagcagctccaaacctccgaaagcttatttatgggacagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggttatgaacagtatcagagattgcttcgtgactggaaagtgggaagatgataaagatgcagccaaggtcttagcagaagatgaggagctctacggtgactttgaagacttggaaacaggggacgtgcacaagggaaaatcaggccccaatactcagaatgaagatatagagaaagaagttaaggaagaaattgaccctgacgaagaagaaagtgccaagaaaaagcatttggataagaagagaaaattgaaggagatgtttgatgcagaatatgatgaaggagaaagcacatattttgatgatcttaaaggagaaatgcagaaacaagcacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggccctatcactccacagggaactggtttcttggcaatacagtctgtcagtggcataatgcctgattttcggatagctgctacaggagttgtccttgatctggataaatccataaaaattgtgaagaaattaaagctaactggttttccatataaaattttcaagaacacttcatttattaagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcgatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcatcagactaaaggcgaacaaggactctctgtataagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacacgtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttaaaaaaaaaaaaaaaaaa

SEQ ID NO: 31360 - DNA, 4927 bp, Homo sapiens
ggcaggtgcagctgccacagtgagacgggcaccccgacccgggcatggaggggggcaaggggcccaggctcagagacttcctgagtgggagtctggctacctgggcgctgggactggccgggctggtcggggaggcggaggactcggagggggaagaagaggaagaggaggaagagccgcccctttggttggagaagagattcctgcgcctcagcgatggggccctgctcctccgggtgctgggcatcattgcccccagctcccgagggggacctcggatgctcagaggccttgacggacctgctgcctggcgagtgtggaacctgaaccacctgtggggccgactgagggacttctaccaggaggagctgcagctgctgatcctgtcgccacccccagacctccagacattgggatttgaccctctctcagaagaagcggtggagcagctggaaggcgttcttcggctactgttgggagcgtcagtacagtgtgagcaccgggaactcttcatccgccacatccagggcctcagtctcgaggtccagagcgagctggccgctgccatccaggaggtgacccagccgggggccggcgtggtgctggcactgtctgggccagatcctggggagctggcacctgccgagctggagatgctgtcccggagcctgatggggacactgtcgaagctggcacgggagcgtgacctgggggcccagcggctggctgaactgctgctggagcgagaacccctctgcttgaggcctgaggctccctctagggctcccgccgagggcccctcgcaccatctggccctgcagctggccaacgccaaggctcagctgcggcgtctgcggcaggagctggaggagaaggccgagctgctgctagactcccaggccgaggtgcagggtttggaggccgaaataagaaggctccgccaggaggcccaggcgctgtcgggacaggccaagcgggccgagctgtaccgcgaggaggcagaggcgctgcgggagcgggccggccgcctgccccgcctgcaggaggagctgaggcgctgccgcgagcggctgcaggcggctgaggcctacaagagtcagctggaggaggagcgggtgctctcgggggtgctggaggcgtccaaggcgctgctggaagagcagctggaggctgcccgagagcgctgcgcccggctgcacgagacccagcgcgagaacctgctgctgcgaacccggctgggcgaggcccatgcggagctggactctctgcggcatcaggtggaccagctggctgaggagaatgtggagctggagctggagcttcagcggagcttggagccacctccaggatcccctggggaggcacccctagcaggagcggccccctcgctgcaagatgaggtgagggaggcagaggctgggcggcttcggacccttgagagggagaaccgggagcttcgggggctgcttcaggtgcttcaggggcagccagggggccagcaccccctgctggaggcaccgagagaggaccctgttcttccagtgctggaggaggctccccagactcctgtggccttcgaccacagccctcagggcttggttcagaaggcaagggatggaggcccccaggccttggacttggctcccccggcattagactcagtgctcgaggcatcagctgagtgtccccaggcacctgattcagacccacaggaggcagagagtccccttcaggcagctgccatggacccccaggcctcagactggtccccgcaagagtcaggctctcctgtggagacacaggagtccccggagaaggctggccgtagatcctctctccagagccctgcctctgtggccccacctcagggtccagggaccaaaattcaggccccgcagttgctgggaggagagacagagggaagagaggctccccaaggcgagttggtgcctgaggcctgggggttgagacaggagggccctgagcacaagccagggccttcggagcccagctctgtgcagctggaggagcaggagggcccaaaccagggcctggacctggccacgggacaagcagaggccagagagcatgaccagaggctggaagggacggtcagggacccagcctggcaaaaaccacagcagaagtcagaaggggctcttgaggtccaggtctgggaaggcccaatcccaggggagagcctggccagtggtgtcgcagagcaggaggccctcagggaggaggtggcacagttgaggagaaaggctgaggcccttggagatgagctggaagcccaggcccgcaagctggaggcccaaaacacggaggctgcccgcctctccaaggagctggcccaagcgcgaagggcagaggccgaggcccaccgggaggcagaggcccaggcctgggagcaagcccggctgcgggaggcagtggaggctgctggccaggagctggagtctgcgtcccaggaacgggaggcgctggtggaggcgctggcagcagcgggccgggagcggaggcagtgggagcgtgaggggtccaggctgcgggcccagtcggaggccgccgaggaacggatgcaggtgctggagagcgagggccgccagcacttggaggaggctgagagggagcgccgggagaaggaggccctccaggcggagctggagaaagctgtggtgcggggcaaggagttgggggcccggctggagcatttgcagcgtgagctggagcaggcggctctcgagcgccaggaatttctgcgagaaaaggaaagccagcaccagaggtaccagggcttggagcagcggctggaagctgagctgcaggcggcggcgaccagcaaggaggaggcgctgatggagctcaagaccagggccctgcagctggaagaggagctgttccagctgcgccagggccccgcggggctggggcccaaaaagcgtgcggagcctcagctggtggagacccagaatgtgcggcttattgaggtggagcgcagtaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaagaagggcagctggctggcagacaaggtgaagaggctgatgcggccccggcgggaggggggcccccctggggggctgcgcctgggggccgatggggctggcagcaccgagagcctggggggccccccggagacggagcttcctgagggcagggaggcagatgggacagggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctgaaaaaaaaaaaaa

SEQ ID NO: 31361 - DNA, 2103 bp, Homo sapiens
aaagtccatgggagccggagcgccgggacgccaagcacttcctgccgcgggcggcgcgccgcagctgcccaggccggaccgggccgggcgcccgcagatgagccccgctagggccgccccgcgctgagagcccagccccgccgctgcccgcccgccatgtctcagatgctgcacatcgagatccccaacttcgggaacacagtgctgggctgcctgaacgagcagcgcctgctgggcctctactgcgatgtgtccatcgtggtcaagggccaggccttcaaggcccaccgggcggtgctggccgccagcagcctctacttccgcgacctgttcagcggcaacagcaagagcgccttcgagctgcccggctccgtgccgcccgcctgcttccagcagatcctgtccttctgctacacgggcaggctcaccatgacggccagcgagcagctcgtggtcatgtacacggccggcttcctgcagatccagcacatcgtggagcgcggcaccgacctcatgttcaaggtgagctcgccccactgcgactcgcagaccgctgtgatcgaggacgccggctccgagccccagagcccctgcaaccagctgcagccggccgccgccgccgcggccccctacgtcgtgtccccctcggtgcccatcccgctgctgacccgagtaaagcatgaagccatggagctgccgccggccggcccaggcctggcccccaagcgcccgctggagacggggccccgggacggcgtggcggtggccgcgggggctgcggtggcggcgggcacagcccctctcaaactgccccgtgtctcctactacggggtgcccagcctggccaccctcatccccggcatccagcagatgccctacccccagggggagcggaccagtccaggcgccagcagcctgcccaccaccgacagccccacctcgtaccacaacgaggaggacgaggaggacgacgaggcctacgacaccatggtggaggagcagtacggccagatgtacatcaaggcctccggcagctatgcagtgcaagagaagcctgagccagtgccgctggagagccgctcctgcgtcctcatccgccgcgacctcgtggccctacctgccagcctcatcagccagatcggataccgctgccatcccaagctctactcggaaggggaccccggggagaagctggagctggtggcaggctctggggtctacatcacacgcggccagctgatgaactgccacctgtgtgcaggggtgaagcataaggtcttgctgcggaggctcctggccaccttctttgacaggaacacgctggccaacagctgcgggactggcatccgctcgtccaccagcgaccccagccggaagccgctggacagccgggtcctgaacgctgtgaaattgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccggcggccgcggcccggaggccggagggcacctatgcagggaccttgtaagcggagctgggtggctgcgcgagggaccgagtactagagctgcttgcatgcgttactaatacaaacaaatgtgatcaagccacttacctactgaactgctactgttgcctgagaaaaatgtgatttttattctgcttgtatttaaaattgatgaaggaaaaaaaaaaaaaaaaaaaaaaaaaa

SEQ ID NO: 31362 - DNA, 1547 bp, Homo sapiens
ttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttccctctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcgctcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactccaaaaaaaaaaaaaaaaaaaa

SEQ ID NO: 31363 - DNA, 2412 bp, Homo sapiens
ggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcaaa

SEQ ID NO: 31364 - DNA, 7401 bp, Homo sapiens
gaagagttctgcactttgttccttccctggcacacctgtgtctgcattccttctatctcccggcattctccactcctgtctctgtgtgtttaaaaaccggtgtgggaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcagaatgcaggtctggtgactgtcactaccactcctctcaactgtggccctcgactgagggtgctcctgggccgccccgcacatgaaaagctgctgatgctgctccccgtggggtaccccagcaaggaggccacggtgcctgacctcaagcgcaaacctctggaccagatcatggtgacagtgtaggcagggccccccaagggagtggcagggagatggcgcccctgcttttccctgagcctctcgcctgctcctcttgggtctcttggctgctctttctccaggtgtcaggtcccctcattgctcttctcaggtggccacactatgtcaagaagcctctccacactctgtggcacttccagtcccataaatcctgtttcttatccactttggaaatgcatgaacactttacaaagaacatgcccgggtttttacattttaaaagttattctagacaatcactattggcttttttcttttatttttaaaaaactcacatagaggagacaatcagaaatttaccatagtcccaagaattcagctacatgatgactcgaatttaaatttagattaatcaaatggtctcctgttctctgatttctggtggcttttagacactaatttttgagaactacttttttttttttaccaaacttcagggacactctgctagttttgaataagtaaccatcaaagttactaaaacatggccaggcgcagtggctcatgcctgtaatcccagcactttgggaggccgaggtgggcagattgcctgagctcaagagttcgagaccagcctggccaacatggtgaaaccccatctctactaaaaatacaaaaaattagctgggcatgcacttgtaattccagctactcaggaggctgaggcaagagaactgcttgaatccgggaggtagagattgcagtgagtcaagatgctgagatgccaccactgcactccagcctgggcaacagagcgagaacctgtctcaaaaaaaacaaaaacaaagttactaaaatgtcaccttcacagaacaggacagggtacccttgggtcgcacgggcctggctggcatgtaaacggtcagttgcactgcctagtggtttggtagatctgacttgtaagcagttcatagaagctgctcaatactcaagaatcttgcaagacagttattaaacattcatagcttgaaattgcccatggtgggagagtttacatcacaaccactacaaatcagcacttgctttcttcttcttaaagagagctgcttaccatacatagcacccacagtgtctcccttctcttctaccccaacccctgaaacacactgacccctattctccagatgacagcacagctgtttgggactgatagggtcacagttgccaggttgggaatgctagatgtagtcttcacccatcaccttctgtcgtcctcccaggggtgtcatatttacagaggcaaactcttacagcttggatgatttctcatcaagcaactctactcacctctttttcccctttccctgtgcgtttcttcttcttgtcctcattttccttgagaaaactctctctataaaaaatttccatagagtatgtggctgataaacaacagaaatttgtttctcacagttctggaggctggaagtccaaggtcggggtgccctcatggtcaggtgctggtgaggaccctgatctgggttgcagactgctgacttcttattgtgtcctcgtggtagaaagagggttagagcctctggcatgccttttataagggtactaatcccatcatgaggccccgtccttatgacctcatcacctcccaaaggaccccctcctaataccatcacattgggggttagggtttcaacatatgaattgcgggggacacaaacattccgtccatggcacctacttcatagggtttggcatgctgctcggtacatggttaacattcataaatggtgggggcccttactgtggtagaaaccattgtcactgcaaggcagccctgcttgggattcaggtgaacaaatgtaacgtgggtgggtgagggactccctcctcttcagagaagccctcctgtggctcaggggcagctgcagggccagatggagttggcctgcagggagtcagccttaccccatcagagaccaacttgaaagatttttttctctgtgtagttcgtgttatcaatctgatctgcagccaggttatttacttctgaagcattggagttatcgattgccattgccccatggttctcactctttgcaggcactcttcaaatttttattttaaaaattataatgcaaacatctggccatcaccttaaccaagtgacaaagtcctagcacaccattaatggtaggataactgacattaagtgttcctgctgggatgaattatgaagtattccttccaaagatgtcaatggaaactaatcgagtcttacacctaattttcagtttacagtaaatacagaggataaagaagttaatggcatggtggaataaccaaaatgtgtatcattctacaaaaaaataggcctggactatttaaggagtgagtgtcactgtgggaagaataagagggggactgtcttgtccttgctactcaaagagtggtcctgggcctgtatcatcattgggaccacctgggcgcttgttagaatcaaagactctcaggcctcacctagacatccagaatcaaaatctgcattttaacaagatgcccaggtgatctgcatgcctgttaaagtctgagctctgttgcagataaccagagacccaacaaccaaaggcaaagcgtaagccttgattggattttggtttaggaaaaatctcataggtataaaagacaactgggaatgttgaatgtggatctggtggtaggtgatattgttagtgatgtgagtgatgcctgctgaagtactgagagatgaagcatcatattgacaacttactccaggaaaaaaggtgtgtgtataggtgtgtgtttggagagtgtgagcgagaactaacatggtaaaatgttaggtggagcatatacagttctcattatactcttattttaaatttatatttgaacacagtcaaatctgaatggaaatacatttaaataagcatttctttcagtcatataagtaatttgcctaaaaatgccctctaagtccatcattaggttaagcgatttactgaaggtgcagatatcatgcttatttcattgggttgttttggaatgtcccccacttggagagtttgaggaatggaaatgagaatcggaggagaaataaggccagaggctcacattgcttgcagggaaccgactgagtaatgaagaagaggaaggaagcccttggaaggaacgtaaaatccatttcagcctgccgccccttggaatggagggtcttctagggaccagaaacaccagacacttcttctgccccaagcacaccccacactaatttctgctgcagcatcacgatcagggcaaatcagcacagccccccagccatcagtggtgtctagaaaagtaaggataattttcttccttctcactgcagccccaagctcttattaaccttcttttatgtgttcattaaatgcagtcatgtgacaactgtgttcaaagttagaaatagtggtcggggaggcttatagatcctcttgctgttctgaggccttaaaaccaaaaaaataatggaatgattgcatcactgcgaggaagtatacttaattaagaaagttgaaaatggtttgtgtcttactaataggactcacctgaagactctactttgccaagagggaatttttaactcaaagttgtgtcagccagcacggggtagagccatggtcctcatacttgctggcatccctcatctggtggtctgttaaagcacagattgctgggccgcaccctcagggtgtgtgattgtgtgattcagtattgctgggtggtgcccaaatgctccagttctaatgtattcccaggtgttgctgatgctggtgattgggtaccacattttgagaaccatggggcattggcaatcaacaaatgcaatgcttgtgacttgacgtgataaaagttcatttattgggcaggcaaagtcctctgcaggcctggaaaccctccgagacaattacttgcatggggtaacccagtaatactgtgggatgcaacttctagggcatggctgcctccttcctagaggcagcagggggagaaaacactggaagaggtcaccccaacaattccatcgtaccttggcctaggagtgacctcctcagtctcacaaccctttggctagaactagtcatgtgacctcacaggaggtggagcagtgtcgtcaatgttatcatccccctgcacctgcaaggaaggaggcccagatgtgtgtaggtgctggatgtctcttccccaaaacatataactctggatttggaaaacaaaactggatataacagaaaagaaaaggaggggagaaggaaagttgaagaaattggtgaaatcagaataggacagtgaaaggcataaagattttcttctgaaacgctaagatcggttgatatttgtctaatacagctttaaatagagtatcactttgggccaaagaaaattgatataaacatacataaagtggaactaagattgacttcttcctagacatctctgcctctgtccacaaaatggaaacttccatcaaggagtactggaggacagttcagtatttcttcttatttgctcctccctatgaaaggaagagtgacttctctgctgcatgatattgggggtaaatagttattgcacatttgctcaaaccccagcaaagtgcaccccattttaagccaaatttacaaacttacaaagatgatccaccaatagttttctctatttactttattcttgctctgtcacccaggctagaatgcagtggtgtgattatagctcactgcagcctccaacttctggactcaagtgatcctcccaccttagcttcccaggtagctgggatacaggtgcacgccaccacacccaggctagtttttctaaatattggagttcccaaagagtattcaaactgatgtgatattttaaaagacattttgtaagcatcttttaggaatatcagtaagtggaagaaaaacacatagttatcagtggatattatgccagagaggcatgagaaatataattttattttgctaggtatcagcagagtgccctcttataatttgtgtgaaatggaaacaaaggtaacatcgtgttttcaattcacacatatatacaagtaatgagaggtccagaagaaatgtggcttcagctctgctgctactgtgcctcccttctcctgccccactcagcccacaaaataggctggacactcaaaaaacgttgcgtttatctaccttttagagagggtgaatagcagagaactggaggtgggaatggtaaggaactcccagcagggtagtggagggaatgggctgacgcatctaaggctgatgccaggtctgctccctatctgggtggcctcagcaaatgacgtccagcacatccaggggcaggctcaagggagaacagcccccaaagctaagatcctgccaagctaaatacagtagttctaatgaaatgtgagaggctataatcccatttgggaaattcctaaaaagtcatgaggcaggggattggtttatgttattatcatgacctgagagtcatggctcagagccaaatgttcaggattgaattcaacagcatttaaatgtctttagagcaggatggaaatatgttagcaatgcctgcagagtgccaagtaaacgcaaaagccaatgagatcataaaggaagttgttagctaacctaggtggagtcgccaacttccttctactctaataattaaaaataaaaataatacttgggaggtaactggaataaaggttctaaaatcaaaaccctctgaagggtgaaaactgggagcctcctgttcccatagtaaccacagcactcagggcactgtctcccagcgctggagtactgtcttatgaccagagatcctaagcaacctctgctcatctgagttgtccaccatattgtgggcatgagtccttgacaatagtaaatagcacctctgttcccttattgggtaaatgattttccaactctgggaatgtgtagaattcattatggaaataatgcaataattcaaatccataatattgatactttcatgttaagtttaggactaatcttgtgtatgctccttaagtgatttgaatctttaaaaagcttatgattccaatttgaaatgtgaaattgattttacgtttgtgatttgaagttgaaaggtataagaatatttaacttagctcatgaaaagtattagactagatttactataagtttaatgtattagatttacaagagatgcttaaatatatgagaatgttttgtcttaattggttataatcttgtcatatcaatgatttgaagtgctaaaatagaaaattaaatatgataaattacacaagaagtttagaatgtttaaaagattttaataaacaaagcctataactaag

SEQ ID NO: 31365 - DNA, 2218 bp, Homo sapiens
atggggctgagcacagcatgcagctggggcccccgtgtcctagggatccgagagcacactgttgggcagcagctcctggacggggcccaccagcctttgtgcaaaccaagaaggagctcgtcccctgacaccattccccctgcacctgatggatccatcgctttgcccagccttggctctcgaggtgaccttcaaggactgctgcaaggactgccccgccaaggagcctggcacaggctgttggacacaaccccaattactgacaggttcgcaaagacacccaagctgcagggccttggcagacggccagggctgagtggcagtgtgggcaccgcggcccgggacgacagcctgggctcagagtcaggcttgtggcttcgcctctcagcttgcgtctcctcccctgtgggatgggggattccgtggcacccccatgatgaacaggatgccatgggcctcagcccagggcagacctcagtgtccttcctgtggccgctgctggaggtgcgtgaccacaacacagggaggggactcgtccccgccactgtgctgacgcctgggtctccagagaccctcctggaactccgccaggccttcctgggttccagacaggcccgccacgggcatgacgcagcgccatctagcggacagcagggctgcagcgtggacagaacggccggacgcccagtcctgggctggcggctgaggaacagcctcacagggcaagagggcaggcaacacctgcatctttccggcataagaacctcaagaaaagcaaaggaatataagcctgtgttctttggagccaccgaaatctctgttctcatggcagtcgctgaaagtttaagggagccgccaccgccccaatggggttggtttctttcttccctgtttttaaagatcttttaaaatgtctagagagaccctgggatccagtgctggacggatgatgcagggccacacagagaggctattgtgtgtcacttgctgggttaggaacagacggatcagggcttctatgctgcgtctgcctggtcctgggagagagaaactcacacaaccatctgcctggaagacctgggcttctcaggctagagggtctgcacatgtaggtgtgtgtgcatgcatacatatgcctgcgtgtggatgtctgtgcttcacacaaacaagtgtacttgtgggcatatgtgtgtgtgtgcctgcatgtgcagctctgggtatgtgtgtgtgcgcatgcccctgagtctctctgcatgtgatgcatttgtgcatgtgtgtgcctgtgtgcccgggtctgtgtctatatatatgcatgcatggatatgcatacgtatgtgcatttctgcacatgtgtgcgtatgcctgtatgtgcctggctatgtgcacacacatgtgaatgtctgagcagctccagagggagggccaccaccctgcatggtggacattagtttgagcctgtgaggaccagtgtcccccaaagcccctcaactacagcccagcccaacccaacccggagcagatcacaggccccagagacatctccaaccctcacacatggttcccaaacccgggctatccttcactctgcaggggcgggccagccctgcccactgccagggacccgctccaaggcgcctgcaggagggctgtgggcgacagtgtgggcgcccaccagcaggagggcctgtcatggtctgtgcacgaagctggtgcgctgtcttctccaggaactcgcaccttcgctccccctcccctgccagccaacactttcaggtttctgccataaaagagaaaaaaatctccctccctctctacccgctccgcgcctgctccttctccactttttgcagatcaaacagcatgcatggagtcgagcctgctggctctgttccgagctgcactttgggcatccgtgggctgccttgctccttgtggggtggcttcaagagcaggtcccaggtgtgcctgcagcagtgccgacacccctgagaacacagcgcaccccagctttcggcgccaaccacacagccagcaactgggcttggaagcttccctgaggtcgacgctgcctggaaatggactttgctgcctgcattcaggccaggggccatgtttgctcccccattacaagttggcctcatattaacatgtctgaggactaaggctggtattctagaacacgcctttcactgattgtgttaaataaaagagaaagatg

SEQ ID NO: 31366 - DNA, 2218 bp, Homo sapiens
atggggctgagcacagcatgcagctggggcccccgtgtcctagggatccgagagcacactgttgggcagcagctcctggacggggcccaccagcctttgtgcaaaccaagaaggagctcgtcccctgacaccattccccctgcacctgatggatccatcgctttgcccagccttggctctcgaggtgaccttcaaggactgctgcaaggactgcccagccaaggagcctggcacaggctgttggacacaaccccaattactgacaggttcgcaaagacacccaagctgcagggccttggcagacggccagggctgagtggcagtgtgggcaccgcggcccgggacgacagcctgggctcagagtcaggcttgtggcttcgcctctcagcttgcgtctcctcccctgtgggatgggggattccgtggcacccccatgatgaacaggatgccatgggcctcagcccagggcagacctcagtgtccttcctgtggccgctgctggaggtgcgtgaccacaacacagggaggggactcgtccccgccactgtgctgacgcctgggtctccagagaccctcctggaactccgccaggccttcctgggttccagacaggcccgccacgggcatgacgcagcgccatctagcggacagcagggctgcagcgtggacagaacggccggacgcccggtcctgggctggcggctgaggaacagcctcacagggcaagagggcaggcaacacctgcatctttccggcataagaacctcaagaaaagcaaaggaatataagcctgtgttctttggagccaccgaaatctctgttctcatggcagtcgctgaaagtttaagggagccgccaccgccccaagggggttggtttctttcttccctgtttttaaagatcttttaaaatgtctagagagaccctgggatccagtgctggacggatgatgcagggccacacagagaggctattgtgtgtcacttgctgggttaggaacagacggatcagggcttctatgctgcgtctgcctggtcctgggagagagaaactcacacaaccatctgcctggaagacctgggcttctcaggctagagggtctgcacatgtaggtgtgtgtgcatgcatacatatacctgcgtgtggatgtctgtgcttcacacaaacaagtgtacatgtgggcatatgtgtgtgtgtgcctgcatgtgcagctctgggtatgtgtgtgtgcgcatgcccctgagtctctctgcatgtgatgcatttgtgcatgtgtgtgcctgtgtgcccgggtctgtgtctatatatatgcatgcatggatatgcatatgtatgtgcatttctgcacatgtgtgcgtatgcctgtatgtgcctggctatgtgcacacacatgtgaatgtctgagcagctccagagggagggccaccaccctgcatggtggacattagtttgagcctgtgaggaccagtgtcccccaaagcccctcaactacagcccagcccaacccaacccggagcagatcacaggccccagagacatctccaaccctcacacatggttcccaaacccgggctatccttcactctgcaggggcgggccagccctgcccactgccagggacccgctccaaggcgcctgcaggagggctgtgggcgacagtgtgggcgcccaccagcaggagggcctgtcgtggtctgtgcacgaagctggtgcgctgtcttctccaggaactcgcaccttcgctccccctcccctgccagccaacactttcaggtttctgccataaaagagaaaaaaatctccctccctctctacccgctccgcgcctgctccttctccactttttgcagatcaaacagcatgcatggagtcgagcctgctggctctgttccgagctgcactttgggcatccgtgggctgccttgctccttgtggggtggcttcaagagcaggtcccaggtgtgcctgcagcagtgccgacacccctgagaacacagcgcaccccagctttcggcgccaaccacacagccagcaactgggcttggaagcttccctgaggtcgacgctgcctggaaatggactttgctgcctgcattcaggccaggggccgtgtttgctcccccattacaagttggcctcatattaacatgtctgaggactaaggctggtattctagaacacgcctttcactgattgtgttaaataaaagagaaagatg

SEQ ID NO: 31367 - DNA, 816 bp, Homo sapiens
ccgccgctgccaccgcctctgatccaagccacctcccgccaggtgagccccgagattctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaaaaaaaaaaaaaaaaaaa

SEQ ID NO: 31368 - DNA, 792 bp, Homo sapiens
ccgccgctgccaccgcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaaaaaaaaaaaaaaaaaaa

SEQ ID NO: 31369 - DNA, 2373 bp, Homo sapiens
cccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttattttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgaaaaaaaaaaaaaaaaaa

SEQ ID NO: 31370 - DNA, 2275 bp, Homo sapiens
ttatttggacaagaggcacattgacccaatttggagacgtattttggaaggaggtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacatttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaaaaaaaaaaaaaaaaaaa

SEQ ID NO: 31371 - DNA, 3675 bp, Homo sapiens
aggctcctgatggaaagggaaggcccctagtcctggcaggatctgccggccccaacccgcatcctttctgcgcaggaaccatggcgcttccccgactctggagctgtccaggtgctgcctggtgatccgcacgcgacgcggcgacgggggcgcgggcgggcaccccgggggctgtccatgccccggatgcggccgcgccccctccccctccagccgggtacccccgcggctgggcggcgttcagggccgcgggcccgtccgggtgccccgtcgggggcgacatcccggcggccgcgctgaggccaccatgtgacacggcgccgcatcgttgtgcgaccaagcagcggcgccctggtgcctctcgtccatgctcctgggccccagccccgcgcaggccaaggatgaggccgaggcccgaaggtagggggctccgggcgggagtcgcgctgtcccccgcgctactgctgctgctgctgctgccgccgccgccgacgctgctggggcgcctgtgggcagcgggcacaccctcgccgtcggcgcccggagctcggcaggacggcgcgctgggagccggccgcgtcaaacgcggctgggtgtggaaccagttcttcgtggtagaggagtacacgggcacggagcccctgtatgtgggcaagatccactccgactcagacgagggtgacggggccatcaagtacaccatctcaggcgagggtgctgggaccatcttcctgatcgacgagctgacaggcgacattcatgccatggagcgcctggaccgcgagcagaaaaccttctacacgctgcgggcccaggctcgggatcgcgccaccaaccgcctactggagcccgagtcggagttcatcatcaaggtgcaggacatcaatgacagtgagccccgcttcctgcacggcccctatattggcagcgtggccgagctctcacctacaggcacgtcggtgatgcaggtgatggcctcggatgcggatgaccccacgtacggcagcagcgctcggctggtgtacagcgtgctggacggcgagcaccacttcaccgtggaccccaagaccggcgtaatccggacggctgtgcctgaccttgaccgcgagagccaggagcgctacgaggtggtgatccaggccacagacatggcgggtcagctgggtggcctctcgggctccactaccgtcaccatcgtagtcaccgacgtcaatgacaacccgccccgtttcccgcagaagatgtaccagttcagcatccaggagtcagcccccattggaacggctgtgggacgtgtgaaggctgaggactcagacgtgggagagaacacagacatgacttaccaccttaaggacgagagcagcagcggcggcgatgtgttcaaggtcaccacagacagcgacactcaggaggccatcatcgtagtgcagaagcgcctggacttcgaatcccagcccgtgcacaccgtgatcctggaggccctcaacaagttcgtggacccccgcttcgccgacctgggcacgttccgcgaccaggcgatcgtgcgcgtggccgtgaccgacgtggacgagccccccgagttccggccgccctccggcctcctggaggtgcaggaggacgcgcaggtgggctccctggtcggcgtggtgacggcgcgggaccccgacgccgccaaccggcccgtccggtacgccattgaccgcgaatcagatttggaccagatcttcgatatcgatgcggacacaggcgccatcgtgactggcaaggggctggaccgcgagacggccggctggcacaacatcacagtgctggccatggaggcggacaatcatgcacagctatcccgggcatccctaaggatccgaatcctggatgtgaacgacaatcccccagaactggccacaccctacgaggcagctgtatgcgaggatgccaagccaggccagctcatccagaccatcagcgtggtggacagagacgagccccaaggcgggcaccgcttctatttccgcctggtgcctgaagctcccagcaaccctcatttctctctgcttgacatccaagacaacaccgctgcagtgcacacgcagcacgtgggcttcaaccggcaggagcaggacgtgttcttcctgcccatcctggtggtagacagtgggccgcccacactgagcagcacaggcacgctcaccatccgcatctgtggctgcgacagctccggcaccatccagtcctgcaacaccacggcctttgtcatggccgcctccctcagccccggcgccctcatcgccctcttggtctgcgttctcatcctggttgtgctggtgctgctgatcctcaccctcaggcgccaccacaagagccacctgagctcggacgaggatgaagacatgcgggacaacgtcatcaaatacaacgacgaaggcggcggcgagcaggacaccgaagcctacgacatgtcggcgctgcggagcctctacgacttcggcgagctcaagggcggcgacgggggcggcagcgcgggcgggggagcgggcgggggctcgggcgggggcgcgggcagccccccgcaggcccacctgccctccgagcgccactcgctgccgcaggggccgccgagccccgagccagacttctcagtgttcagggacttcatcagccgcaaggtggcactggcggacggggacctgtcggtgccgccctacgacgccttccagacctacgccttcgagggcgcggactcgccggccgcctcgctcagctccctgcacagcggctcgtcgggctccgagcaggacttcgcctatctcagcagctggggtccgcgcttccggcccctggccgcgctctacgccggccaccgcggggacgacgaggcccaggcctcctagcccctcgccctgccgtcggggcgcggctgctcacccgcccagcacacgccggggccccaggacaacgcgtttcccccgcggaccccctttcctgccctcccccaaccctcccttggcggctggacggaggggggacttgctaggagcggactcttccattcctcctcctctaggggtgcagctttggagcccagaggtgcgggattctgaccaacggcattaaaactgaggcgagaccgggcacggtgtggctctggggttagaatgggagatgggggtggcgttgcagagtcgggaaggggcgggtcactcaatcctggcctgggggagaatgctggagggagcacgccgctgagatgcccccaccccaggtttcccccatcagagttaagaggaaagaaggctgttcacttactaagcacctactgtgtgctgggacgctgtacagagaccagctcagtcgtcagagaaaccatgaggtggtgtcctgcacggaatagaaggggaaaggaccccagagaagtggctgtgacccgtccaagggcacctggccagtgaatggcagagcctctggcactgaccagctgcctggcctcgggcaagtcacttcacttctctggtcctcagtttcctcatctgtcaaatggggttaataacagaacctacctcgaagagttgtgaggctaaaaagggttcatatgtgtcaagtggttaggacagtgcctggcacatagtaggtgttcaataaatgctagcctttgttactattaaaaaaaaaaaaaaaaaa

SEQ ID NO: 31372 - DNA, 566 bp, Homo sapiens
tgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaacagaaaaaaaaaaaaaaaaaaa

SEQ ID NO: 31373 - DNA, 3384 bp, Homo sapiens
agggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccaacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtcttttttttttatctctcttgatgtcagattttatagtctttttaaataaatccatttaattaaaacgttaaaaaaaaaaaaaaaaaa

SEQ ID NO: 31374 - DNA, 746 bp, Homo sapiens
ggggccggcccagcaaatcttttgtccggggcggcgctgagccagcagggcgctgcccggtgtaaacggggacccgcggaaggggcggggcgcaccatggcgcagcgctcggggaagatcactctctatgaaggcaagcacttcacagggcagaagctggaggtcttcggggactgtgacaacttccaggaccggggctttatgaaccgagtgaactccatccacgtggagagcggagcctgggtctgcttcaatcaccccgacttccggggccagcagttcatcttggagcacggcgactaccccgacttcttccgctggaacagccacagtgaccacatgggctcctgtcggcctgtaggaatgcacggagaacatttccgcctagaaatcttcgagggttgcaacttcacgggccagtgcctggagttcctggaggacagccccttcctccagagcaggggctgggtcaagaactgtgtgaacaccatcaaggtgtacggggacggagcagcatggagccctagaagcttcggagctgaggacttccagctgagcagctctcttcaatcagatcaaggaccggaagaggccaccacaaaaccagcaacaacccagccacctttcctgactgcaaacctctgagcctggaaccgattgacatgtaaatgcacctgcaccgtttctgagccgggagagtgtttacttaaaatcatgccctcaaaaaaaaaaaaaaaaaaaaaaaa

SEQ ID NO: 31375 - DNA, 4199 bp, Homo sapiens
gaattccggccagagtcacacacggtcctaagagctgggcaccaggaagcgaaggctgatctgaagaagacacttgaatcatgggtgacgttaaaaattttctgtatgcctggtgtggcaaaaggaagatgaccccgacctatgaaattagagcagtggggaacaaaaacaggcagaaattcatgtgtgaggttcaggtggaaggttataattacactggcatggggaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacacaccatggaggacctcttctccacatcttggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaatccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttacaccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggatacagcgttcgatttgagtctgtacttcctcgtcctcatgccagtataatgttttgtactgtaggtgtgctcctgagaaaattagaagcaggcattcgaggaatcagtcatgtaattgtagatgaaatacatgaaagagatattaatactagcttccttctggtagtactgcgtgatgttgttcaggcttatcctgaagttcgcattgtttttatgtctgctactattgataccagcatgttttgtgaatatttcttcaattgcccatcattgaagttatggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaatgatgttgtttatgtcattgactcctgcaagcagaaagtgaaactcttcactgctcacaacaatatgaccaactattctaccgtatgggcatcaaaaacaaaccttgagcaacggaaagggcgagctggccggagtacggctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcgtcaatgaaggaaagcaactgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaattacccatctcccttctttgtatttggtgaaaagattcgaactcgagccatctctgctaaaggcatgactttagtaccccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctgagccctcagctgctggtatcaaccttatgattggcagtacacggtatggagatggtccacgtcctcccaagatggcccgatacgacaatggaagcggatatagaaggggaggttctagttacagtggtggaggctatggcggtggatatagcagtggaggctatggtagcggaggctatggtggcagcgcaactccttcgggcaggatatgtgcaggtgttggtggaggctatagaggagtttcccgaggtggctttagaggcaactctggaggagactacagagggcctagtggaggctacagaggatctgggggattccagcgaggaggtggtaggggggcctatggaactggctacttggacattgaagaggaggtggcggctataaaacttggttatgtcagttctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttattttatgtaaaatataacgatcttcttttaaaaataccacagtttgtatttttctttaaggagtaaagatttgcctttaaataacttggtattttcctggctttcgtttaatacaatagaaaataaagtattacaccg

SEQ ID NO: 31376 - DNA, 1378 bp, Homo sapiens
cattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacctgggaagccaaagttcagctcaaagagattttgattaattctgggtttccagaagattgtttgttgacacaagtgtttactaacactggaccagataataatttggatgttgttatctccctcctggcctttgtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccg

SEQ ID NO: 31377 - DNA, 6395 bp, Homo sapiens
gcctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaaatgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaaggcttatctctgcccccattgatttttaacctcaaaatggtgttgagatttacgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctagagggcaggttagagacagtatgtatgccttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagctaaaaaaaaa

SEQ ID NO: 31378 - DNA, 6129 bp, Homo sapiens
aagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacagctaaattgtcctccatcaggttttagcaaagatggacacattttatgactagtatatgaagcttataaaagcagactactggtctactcacatttggatttatggatggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaaatgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaaggcttatctctgcccccattgatttttaacctcaaaatggtgttgagatttacgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctagagggcaggttagagacagtatgtatgccttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagctaaaaaaaaa

SEQ ID NO: 31379 - DNA, 6703 bp, Homo sapiens
gcctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagaggtaactggattagggacgagtacgccagctttttttttttttttttttttttttttttaacatcttaaatcctgaaaaaaaaaaaaaaaaaaaaaaaaaggcagcagctccgaattgaatgaattgatgggcacactccaactgctgggctggagagactggacttagtcttgccatttctgcttctttgaaagaggagacaacttgggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaaatgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaaggcttatctctgcccccattgatttttaacctcaaaatggtgttgagatttacgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctagagggcaggttagagacagtatgtatgccttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagctaaaaaaaaa

SEQ ID NO: 31380 - DNA, 3065 bp, Homo sapiens
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagccacaaaaaaaaaaaaaaaa

SEQ ID NO: 31381 - DNA, 1690 bp, Homo sapiens
tgagagttgagggagcagccgtttcgggtgggcccaggcgaggagctgacaggaatcggcgtgtgtcccgctctggactacatttcccagagggcctggtggcctgccacttttctcgcaggaattcgaacgtttcgtcactcctggcgggacccttagatctgggaggaaacctctctgaggtctggtcagattccaaccctggacagcagtgaacacaacctttcccctgagccactggaattggacagaatgccccattctcctctgatctccattcctcatgtgtggtgtcacccagaagaggaggaaagaatgcatgatgaacttctacaagcagtatccaaggggccggtgatgttcagggatgtttccatagacttctctcaagaggaatgggaatgcctggacgctgatcagatgaatttatacaaagaagtgatgttggagaatttcagcaacctggtttcagtgggactttccaattctaagccagctgtgatctccttattggaacaaggaaaagagccctggatggttgatagagagctgactagaggcctgtgttcagatctggaatcaatgtgtgagaccaaaatattatctctaaagaagagacatttcagtcaagtaataattacccgtgaagacatgtctacttttattcagcccacatttcttattccacctcaaaaaactatgagtgaagagaaaccatgggaatgtaagatatgtggaaagacctttaatcaaaactcacaatttatccaacatcagagaattcattttggtgaaaaacactatgaataaggagtatgggaagtcctttagtcgtggctcactcgttactcgacatcagaggattcacactggtaaaaaaccctatgaatgtaaggaatgtggcaaggcttttagttgtagttcatatttttctcaacatcagaggattcacactggtgagaaaccctatgaatgtaaggaatgtggaaaagcctttaagtattgctcaaaccttaatgatcatcagagaattcacactggtgagaaaccctatgaatgtaaagtatgtggaaaagcctttactaaaagttcacaactttttctacatctgagaattcatactggtgagaaaccttatgaatgtaaagaatgtgggaaagcctttactcaacactcaaggcttattcagcatcagagaatgcatactggtgagaaaccttatgaatgtaagcagtgtgggaaggcctttaatagtgcctcaacacttactaaccatcacagaattcatgctggtgagaagctctatgaatgtgaagaatgtagaaaggcctttattcagagctcagaacttattcaacatcagagaatccatacagatgaaaaaccatatgaatgtaatgaatgtgggaaggcctttaataaaggctcaaatcttactcgacatcagagaattcacactggtgagaaaccctatgactgtaaggaatgtggaaaggcttttggtagtcgctctgacctcattcgccatgagggaattcatactggttgaatgacagtaaagtaagaccattttgttaacctttataataatttttttaaaacaggtaaggagaacaaattaggatacatattatcaaaggttctcctatgtattcgtttttaaacgatacgataacaaagtaccaagtac

SEQ ID NO: 31382 - DNA, 4165 bp, Homo sapiens
ggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagta

SEQ ID NO: 31383 - DNA, 5740 bp, Homo sapiens
cgccgccgccgcacgccgcctgcctcctgcacgccgccgccgcgcctagcgcccgggcccgcgacaccgcccgctaagcgccgggccgagttcacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccc

SEQ ID NO: 31384 - DNA, 4109 bp, Homo sapiens
agcgggaggactggggcggcgcggcgcggcgcggtgcatttccaggcgctgctctccgtcgcagagaaccctgagctcggcgcgccgagagtcccagcagggcaagggggcgcggcgtcctggtcctcgagcttgggagacagatgcgcatgggcgtgggggcatgcggacctaagctcgggtgaagctctcgggaagggcaagactgcggcgacgagatgcgagcagaggagccctgcgcccccggggcccccagcgccctgggagcccagcgcacgccgggccccgagctgcgcctgtccagccagctgctgcccgagctctgtaccttcgtggtgcgcgtgctgttctacctggggcctgtctacctagctggctacctggggctcagcataacctggttgctgctcggcgccctgctgtggatgtggtggcgcaggaaccgccgcgggaagcttgggcgcctggccgccgccttcgaattccttgacaatgaacgcgagttcatcagccgcgagctgcggggccagcacctgccagcctggatccacttcccggacgtggagcgggtcgagtgggccaacaagatcatctctcagacctggccctacctaagcatgatcatggaaagcaagttccgggagaaacttgagcccaagatccgagagaagagcatccacctgaggacctttacctttaccaagctctactttggacagaagtgtcccagggtcaacggtgtcaaggcacacactaatacgtgcaaccgaagacgtgtgactgtggacctgcagatctgctacatcggggactgtgagatcagtgtggagctgcagaagattcaggctggtgtgaacgggatccagttgcagggcaccctgcgggtcatcctggagcccctcctagtggacaagccctttgtgggagccgtgactgtgttcttccttcagaagcagcacctacagatcaactggactggcctgaccaacctgctggatgcgccgggaatcaatgatgtgtcagacagcttactggaggacctcattgccacccacctggtgctgcccaaccgtgtgactgtgcctgtgaagaaggggctggatctgaccaacctgcgcttccctctgccctgtggggtgatcagagtgcacttgctggaggcagagcagctggcccagaaggacaactttctggggctccgaggcaagtcagatccctacgccaaggtgagcatcggcctacagcatttccggagtaggaccatctacaggaacctgaaccccacctggaacgaagtgtttgagttcatggtgtacgaagtccctggacaggacctggaggtagacctgtatgatgaggataccgacagggatgacttcctgggcagcctgcagatctgccttggagatgtcatgaccaacagagtggtggatgagtggtttgtcctgaatgacacaaccagcgggcggctgcacctgcggctggagtggctttcattgcttactgaccaagaagttctgactgaggaccatggtggcctttccactgccattctcgtggtcttcttggagagtgcctgcaacttgccgagaaacccttttgactacctgaatggtgaatatcgagccaaaaaactctccaggtttgccagagtgaaacaaggtcagcaaagacccttcttcctatgtcaaactatctgtaggcaagaagacacatacaagtaagacctgtccccacaacaaggaccctgtgtggagccaggtgttctccttctttgtgcacaatgtggccactgagcggctccatctgaaggtttgatggaagaagggctcttgaaacagagttaagaggtttctaagccaggcgggctgggaagcttgaagtgcaccttgagcaggttctcctggcagcgtttaaagtcagccccttgtatgtaagagaggacactggggccccacaaggcctcatctccttaaggctagtgcctgaggtcactgtatagggggatgtgggaggataaatcctcaagtcccttgactttccctgcaaaagggtctttatatttgctacacagtacccagagcagcctatctacacaggacattaataatggtgtactttaaaaaatatatgtttcatttaatcttcacaagatctgtagagtaagcaaagagaggcaaaaacaatgtcttgtccaagatctcatgaccaacaagtggtggagctgggatcttttagggccctgagccctgcctggagagcagcacagctcatcagtccccaaagccccctggctctgggcatttgacagactagctcatacagatcataattgcctctactctgagtcactatcttccctgacagaagacaaggaccaggtctggcctgatcccattctagttttcagaataggaccagatgcccatagaagcacagtacagactgaagtaaacccaaacttggctggggctcagatgctagtagtggagtggtggggcttggttatcctcttgttttgtgactggaccactgcccaggtgcttgatgatgaccaggagtgtgctctgggaatgctggaggtccccctgtgccagatcctcccctatgctgacctcactcttgagcagcgctttcagctggaccactcaggcctggacagcctcatctccatgaggctggtgcttcggttcctgcaagtggaggaacgagagctggggagcccatacacaggacctgaagccctaaagaaaggccctctgctcatcaagaaagtggctaccaaccagggtcccaaagcccaacctcaggaagaaggccctacagatttgccatgtcccccagaccctgcttctgatactaaggacgtatccaggagtaccacaaccaccaccagtgctaccaccgttgccactgagcccacatcccaagagacaggcccagagcctaaaggcaaggacagtgccaaaaggttctgtgagcccatcggggagaagaagagtccagccaccatcttcctgactgtcccaggtccccactctccagggcccatcaagtcacccagacccatgaaatgccctgcctccccattcgcatggccgcccaagaggctggctcccagcatgtcctcgctcaactccttggcctcttcttgctttgacctggcagatatcagcctcaacattgagtatgcacctctctgcttaatcttttctaaaatcgcctgtatgaaaaatacctcgctggatggaaaagtagatatgaacttacatttctgtgcaagttgttttttcacaaaatatcttcctaagaggcagcatggtgtggtagaaagaacacaggacaagggagagagagccaaacaggctgtttatggctctagctgcgtactgactataaaatagatgctggactctggttgaggtggggacctcaggcgacggcagctgggtgagattcagctcacagtgcgctatgtgtgtctgcggcgctgcctcagcgtgctaatcaatggctgcagaaacctaacaccatgtaccagcagtggagctgatccctacgtccgtgtctacttgttgccagaaaggaagtgggcatgtcgtaagaagacttcagtgaagcggaagaccttggaacccctgtttgatgagacatttgaattttttgttcccatggaagaagtaaagaagaggtcactagatgttgcagtgaaaaatagtaggccacttggctcacacagaagaaaggagttaggaaaagtactgattgacttatcaaaagaagatctgattaagggcttttcacaatggtatgagctgactccaaatggacagcccagaagctgatgatgagaattcttatcactcacctttatattaaaatgtatatatatgtatatattttttcctttggatcacttacatccaatatatgtatattttgtcatttaaatcagaacaaccacttgaaattatatacatacaattcttgtgtggaatttaactccatgactgaatagcataaggaagaggttatttaaaagcaagaactaaaaaaaaaaaaaaaaaaaaaaaaaaaaaaaaaaaaaaaaaaagaaaaaaaaaaaaaaa

SEQ ID NO: 31385 - DNA, 4996 bp, Homo sapiens
agtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccatatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacatcagagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggacgtggccgctttggagagtcagcctttattaggattcactgttattcaagttaaagatgagaattccgagtctaaagtatttcagttactgcacaaaaacatgttattttatgtattcaaagcagaggatgctcattcggctcagaagtggatagaagcatttcaggaaggcacaatattgtagcagtattggtttcatctcttctgtgattccaaagaggtggaatttcatcagaatggagtaaatgcaattcaaaaattgtataaaaatgaacactgccaagataaagccaaccagacccttcatcaaagaaattgttttgttaggtataagcaatttttaaaaggtgtttgttttttcatttatgttatttattaaaattttgatgtttacttaatggtcagaattatttctgagacacactgaattctaaagtaccatttctttagagaccagaaaaactatcttaatactgtatactgtattaactattcgtgacatagttcacactgttttcttaccttacattgtaacaatcttactggtggaaagtctttgtaaggaaaaaacacatagcaaggagcaaatttccacaaagtgcttggtttaggaattgtgattattataaaactgctgatgaaaaaaatgcatgtctttgaatc

SEQ ID NO: 31386 - DNA, 4587 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttaaaaaaaaaaaaaaaa

SEQ ID NO: 31387 - DNA, 4574 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgaggcagcccgcgggcgtcatgcccgcgctcctccgcagcctggggtacgcgctgaagcccgggaggcttggcgccggcgaagacccaaggaccactcttctgcgtttggagttgctccccacaaccccgggctcgtcgctttctccatcccgacccagccggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactt

SEQ ID NO: 31388 - DNA, 4223 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccccaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactt

SEQ ID NO: 31389 - DNA, 1859 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgctgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtgggcagccagggtttatgagctttgcatgatcctcatggttcccaagcgtcatctgtgtaaagtggacgtggtatgaaatgtctgacattttggaagctgagattactctgaaaatgttaattgggcaggtgaaaagggtacagatgtgctgtagcagacctttggttttaaaagagaagcatcatttccccaacagggcaactgtagaaggccagctgaagagtaaaggaaaaggtctgaggactgagcctgtggctggctggaaaaaggtgaatgttgagggcccttcacttccatcacaagaaagtcattagacggtaccaattcagtgtctgttcctggcatctatttcctctgtgcaaagggaaccatgtatatgagcttataaatacatttttgtcagagtgcacagataagtaggccattttaattaaacattgaagaccctgtctcaaaaaaaaaaaaaaaaaaagaaaagaaaagaataaagaaaaaacccattactccaagacgtttagc

SEQ ID NO: 31390 - DNA, 4575 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgctgaagcccgggaggcttggcgccggcgaagacccaaggaccactcttctgcgtttggagttgctccccacaaccccgggctcgtcgctttctccatcccgacccagccggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactt

SEQ ID NO: 31391 - DNA, 3216 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgctgaagcccgggaggcttggcgccggcgaagacccaaggaccactcttctgcgtttggagttgctccccacaaccccgggctcgtcgctttctccatcccgacccagccggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcgcctgtaatcccagctactccgggaggctgaggcaggagagtcacttgaaccggggaggcggaggttacagtgagccgagatcatgccattgcattccagccttggcgacagagcgagactccatct

SEQ ID NO: 31392 - DNA, 3219 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgctgaagcccgggaggcttggcgccggcgaagacccaaggaccactcttctgcgtttggagttgctccccacaaccccgggctcgtcgctttctccatcccgacccagccggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgcgggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcgcctgtaatcccagctactccgggaggctgaggcaggagagtcacttgaaccggggaggcggaggttacagtgagccgagatcatgccattgcattccagccttggcgacagagcgagactccatct

SEQ ID NO: 31393 - DNA, 4319 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttaaaaaaaaaaaaaaaa

SEQ ID NO: 31394 - DNA, 1807 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgctgaagcccgggaggcttggcgccggcgaagacccaaggaccactcttctgcgtttggagttgctccccgcaaccccgggctcgtcgctttctccatcccgacccacgcggggccggggacaacacaggtcgcggaggagcgttgccattcaagtgactgcagcagcagcgcagcgcctcggttcctgagcccaccgcagctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacacctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggt

SEQ ID NO: 31395 - DNA, 4667 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgctgaagcccgggaggcttggcgccggcgaagacccaaggaccactcttctgcgtttggagttgctccccacaaccccgggctcgtcgctttctccatcccgacccagccggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagtcagcctctcgaaccgtattcaccttgttatcctgacccaagatgaaataaaacgtctctcttcccttctttcaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgttctggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactt

SEQ ID NO: 31396 - DNA, 4305 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgctgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgttctggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactt

SEQ ID NO: 31397 - DNA, 4222 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgcaagcctgagtcctttcttcctctcgttccccaaatccgagggcagcccgcgggcgtcatggcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggccggggacaacacaggtcgcggaggagcgttgccattcaagtgactgcagcagcagcgcagcgcctcggttcctgagcccaccgcagctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagacggatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgttctggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactt

SEQ ID NO: 31398 - DNA, 4216 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgcaagcctgagtcctttcttcctctcgttccccaaatccgagggcagcccgcgggcgtcatggcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggccggggacaacacaggtcgcggaggagcgttgccattcaagtgactgcagcagcagcgcagcgcctcggttcctgagcccaccgcagctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagacggatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgttctggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactt

SEQ ID NO: 31399 - DNA, 2154 bp, Homo sapiens
gccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatccaa

SEQ ID NO: 31400 - DNA, 4015 bp, Homo sapiens
cgaacgagcggcgctcggcggggacagaaagagggagagagagagagagagagagggagaggcgcggccgggcgaggcgggcccgtccgggagcgggctccggggaaggggtgcgggtctgggcgccggagcggggagcggggccgcgtccctctcagcgccagctctacttgagccccacgagccgctgtccccctggcgcgctcggggccgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaaaaaaaaaaaaaaaaaaaaaaaaaa

SEQ ID NO: 31401 - DNA, 3037 bp, Homo sapiens
agttagttgccattcggagtgaggagtgggtagaagcggcggcggcggcggcggcgtttgcggtggcgcggactccgaggagcgccagcacctcgaggccctttctctctaccctggtccccagaagcaggggtcccggccctccttgcagctgccgggttctcccgtgcgtgcagccctgcgagggctgaggagaaggctgcgagcggccctcggggctgcgtgatccgggccgttgccctgtcagcacgatgcctggagcggtggcggcggcggctccgggctccttgcggccccggccgtgaccgccacaccgagcccagccgggcggttgcggccgttggacgtttgttttcgcagccttcccctcccccctcgccgaggcggcgggggtgtgcgttggggagggggagccccgagactcctcccccacagcgatacccccgcccctcccccttacacactcgcacgcactatcgcgccggctcccacacgctcgcgcgcctcccgccccgcgcctccgtgtcggccggcggcgtccagggcccgcagagccaccatgtccactgcctcctcctcctcctcctccagttcctctcagacccctcatcccccgtcgcagaggatgaggcgcagcgccgcggggtccccgcccgccgtcgccgccgccgggagcgggaacggtgcgggcggcggcggcggcgtgggctgcgccccggctgcgggagccggccggctgctgcagcccatccgcgccacggtgccctaccagctcttgcggggcagccagcacagtcccacgcgtccgcccgtcgccgctgccgccgcctcgctgggcagcctcccggggcccggcgcggcccgcggccccagcccgtccagcccgacgccgccggcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactctcctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaagggggagctggcctccaccctgtgttccatggattcggaacaagatttcagacatctgcatgagtgacaaactttctgaacaccaccaccaccaataatacttatcagcatcataaagtatctcttaaacactgatcttggcagggacggaactcctattcagcagtttttgtggaaagcagtaatgcttgcaaaacgtgtgtgtcattcagcattttaagtggagactatgcatttcatagtatatttgacagattagtactgtgtcctgtgttttgttccagattcttcagtataaataagctctatatcaaaaagttgcctgtctaaatagaaaatgtcttgctgtgttttgtcctatggaaaatactgtaattcaggattatgtttacaattgatccaggtgtttgtttctaacttctgtaatacatacaatgcaaaaaaaaaaaaaaaaaatggccacaacagttgcacagtgcccaccctatggcctagcttcaggtacttcagttgaagtctaaactcaggtaacttggaatgtatatcatattgggatattaaatatttcacagctaaaaagctaaagagggaacatcactcttttgcctttccttattttatgcatttccctttcctcattacattccacattcttagaataagaagtgcattcaatcctaggagaatgataatcctggacatgggtgaacatgaggagaaccagcaaaatctgtggtgtttgacatcactttgtcatgtggttacaagtaaaacaactgttgcattcactgtttcaaaaaaaaaaaaaaaaaaagaaaaaaaaaaaaaaaa

SEQ ID NO: 31402 - DNA, 698 bp, Homo sapiens
cacaaactgggaggaaaactgagacctcctggtacccgccgccgggccttttagaaactcccacaagctctgccttccctccctggtcctcttcagaccccctcttagttcttcgcggctaacggctcgcgctcggggccgggtgtggagctggaacagagggctggcaaggcgcgcatcggaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgatattcaagagagctacatttgaagcctgtacaaaagcttatccctgtaacacatgtgccataatatacaaacttctactttcgtcagtccttaacatctacctctctg

SEQ ID NO: 31403 - DNA, 2473 bp, Homo sapiens
tctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgctgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaaaaaaaaaaaaaaaaaa

SEQ ID NO: 31404 - DNA, 6895 bp, Homo sapiens
ccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaaaaaaaaaaaaaaaaaaa

SEQ ID NO: 31405 - DNA, 1799 bp, Homo sapiens
tgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcaccggcccgatagccccgggggcggcctgcaggcgccgggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaacaactatcccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagacaatagatgttgcttttcccgtgtcatgtaaatttgttcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagatggaccccccggaggttgtaaaatagactccatggagactcttaggaagcagtagataccccggggctgtgctttagcgttagaggaaaccacataggagctggaacctgttaatggaaagcagtcacagctggaggtttttcggaagaaccaaggaagattaaaatacattgcacttacaaaaaaaaaa

SEQ ID NO: 31406 - DNA, 2585 bp, Homo sapiens
gggagctggtccctgcgctccctgcgccctggggatgcccctgccgccctgacgcccgccagcctgagccaccggcgcatgtgaccgcgcgtccgccccagtcccatccgtaggcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcctggggagtttgtggtggccatcggcagtcccttcgccctacagaacacagtgacaacgggcatcgtcagcactgcccagcgggagggcagggagctgggcctccgggactccgacatggactacatccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagactggaagaagcgcttcatcggcatacggatgcggacgatcacaccaagcctggtggatgagctgaaggccagcaacccggacttcccagaggtcagcagtggaatttatgtgcaagaggttgcgccgaattcaccttctcagagaggcggcatccaagatggtgacatcatcgtcaaggtcaacgggcgtcctctagtggactcgagtgagctgcaggaggccgtgctgaccgagtctcctctcctactggaggtgcggcgggggaacgacgacctcctcttcagcatcgcacctgaggtggtcatgtgaggggcgcattcctccagcgccaagcgtcagagcctgcagacaacggagggcagcgcccccccgagatcaggacgaaggaccaccgtcggtcctcagcagggcggcagcctcctcctggctgtccggggcagagcggaggctgggcttggccaggggcccgaatttccgcctggggagtgttggatccacatcccggtgccggggagggaagcccaacatccccttgtacagatgatcctgaaagtcacttccaagttctccggatattcacaaaactgccttccatggaggtcccctcctctcctagcttcccgcctctgcccctgtgaacacccatctgcagtatcccctgctcctgcccctcctactgcaggtctgggctgccaagcttcttcccccctgacaaacgcccacctgacctgaggccccagcttccctctgccctaggacttaccaagctgtagggccagggctgctgcctgccagcctggggtccctggaggacaggtcacatctgatccctttggggtgcgggggtggggtccagcccagagcaggcactgagtgaatgccccctggctgcggagctgagccccgccctgccatgaggttttcctccccaggcaggcaggaggccgcggggagcacgtggaaagttggctgctgcctggggaagtttttcctccccaaggcggccatggggcagcctgcagaggacagtggacgtggagctgcggggtgtgaggactgagccggcttccccttcccacgcagttttgggatgcagcagccgctcgcatggaagtgccgcccagaggcatgcaggctgctgggcccccccccctcatccagggaacgagtgtgtctcaaggggcatttgtgagctttgctgtaaatggattcccagtgttgcttgtactgtatgtttctctactgtatggaaaataaagtttacaagcacacggttttcaaaaaaaaaaaaaaaaaaaaaaaaaaaaaaaaaaaaaaaaaaaaaaaaa

SEQ ID NO: 31407 - DNA, 993 bp, Homo sapiens
attccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtgaaaaaaaaaa

SEQ ID NO: 31408 - DNA, 1234 bp, Homo sapiens
attccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtgaaaaaaaaaaaa

SEQ ID NO: 31409 - DNA, 3250 bp, Homo sapiens
cggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttgaaaaaaaaaaaaaaaaaaaaaaaaaaaaaaaaaaaaaaaaaaaaaaaaaaaaaaaaaaaaaaaa

SEQ ID NO: 31410 - DNA, 4205 bp, Homo sapiens
gaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaaaaaaaa

SEQ ID NO: 31411 - DNA, 4346 bp, Homo sapiens
gaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggtttattaacaaaactaggatacccaagactgaagaaacaagaagaaacctcaagtgtattgacacgtaaagaagcagcagtcctgccccagttctcctaagaaaaatccgctgtgggcagagaacgatgatgatttaatggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaaaaaaaa

SEQ ID NO: 31412 - DNA, 2735 bp, Homo sapiens
atgggcatccagggcatggagctgtgcgccatggccgtggtggtgctgctgttcatcgccgtcctcaagcagttcggcatcctggagcccatatccatggaagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaaaaaaa

SEQ ID NO: 31413 - DNA, 2928 bp, Homo sapiens
gacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaaaaaaa

SEQ ID NO: 31414 - DNA, 5355 bp, Homo sapiens
ggccggggctgtcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaaaaagtaataatttctcaatgaattttaaaaatgggcctattttctatccccgtggttcatctgatataattagtgttccctgtgaattccccccctctatgggaaggatgcctttactctttatcagtaataaattatgactgttttcatattgccttagggttatttccctgtgtaaaccattgtcttttgttttggttttctttagcattatgaagctttggtattgtacaaggtcagtagtaagatgctcactagtctcagggcttgtgtaatattctgggaggtcatttaaatgccagaaatggtcaagcaattatacacagtatttatgactctgttaagcataccgtttgtctgtcacattagtagattctgagattaaaaaaaatttttaaagagtgatcatttaaataatttctaaaagggtcttttcaagctctaacaaagtcactaacaaatgcattattttctacagaattagatgttagtagtacagtactgcatattcagggaaaaagtgtgaggaattgatttcaaaatagttcgttcttgtgtttgacctaagaatgattgtcgcatgaagtgtttgtttttacagtttagcatatataaacaaacatgataggattccttaagatgttaccacccagggggccacaagccagcctgctgtctcaggaagctgtagaaggagtgtttgtcaatttcttgtcactggtttgctgacttactgaggattaattgttgccttacaatgttactgaaataaactgtttaatataaaaaaaaaaaaaaa

SEQ ID NO: 31415 - DNA, 4231 bp, Homo sapiens
atagccacggtaacggcggggtggaaagctaaggcctttgaagacctgggaccccgtagtttcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaagtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctgatttatctttaattctgtgctaggtacttttgattctacatgaacaatacccttttcagttcccttcattctaatgtcctcaactgttaccaaataccctgttgactcccaaacctaagattttagcctcaacttcttttctgaacttcaaatcttaatttccaagttatacttgttctaggtccatctaaatggtctacagagaacttcagttgaatcatagctggaaacagaatttatttcctctatttgcttcattctgtccttccactatattccctattt

SEQ ID NO: 31416 - DNA, 4870 bp, Homo sapiens
cggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctgatttatctttaattctgtgctaggtacttttgattctacatgaacaatacccttttcagttcccttcattctaatgtcctcaactgttaccaaataccctgttgactcccaaacctaagattttagcctcaacttcttttctgaacttcaaatcttaatttccaagttatacttgttctaggtccatctaaatggtctacagagaacttcagttgaatcatagctggaaacagaatttatttcctctatttgcttcattctgtccttccactatattccctattt

SEQ ID NO: 31417 - DNA, 4523 bp, Homo sapiens
atagccacggtaacggcggggtggaaagctaaggcctttgaagacctgggaccccgtagtttcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctgatttatctttaattctgtgctaggtacttttgattctacatgaacaatacccttttcagttcccttcattctaatgtcctcaactgttaccaaataccctgttgactcccaaacctaagattttagcctcaacttcttttctgaacttcaaatcttaatttccaagttatacttgttctaggtccatctaaatggtctacagagaacttcagttgaatcatagctggaaacagaatttatttcctctatttgcttcattctgtccttccactatattccctattt

SEQ ID NO: 31418 - DNA, 4997 bp, Homo sapiens
gctccggctcagccgctggcacccccaccgccaccaccctagtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctgatttatctttaattctgtgctaggtacttttgattctacatgaacaatacccttttcagttcccttcattctaatgtcctcaactgttaccaaataccctgttgactcccaaacctaagattttagcctcaacttcttttctgaacttcaaatcttaatttccaagttatacttgttctaggtccatctaaatggtctacagagaacttcagttgaatcatagctggaaacagaatttatttcctctatttgcttcattctgtccttccactatattccctattt

SEQ ID NO: 31419 - DNA, 4762 bp, Homo sapiens
gctccggctcagccgctggcacccccaccgccaccaccctagtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctgatttatctttaattctgtgctaggtacttttgattctacatgaacaatacccttttcagttcccttcattctaatgtcctcaactgttaccaaataccctgttgactcccaaacctaagattttagcctcaacttcttttctgaacttcaaatcttaatttccaagttatacttgttctaggtccatctaaatggtctacagagaacttcagttgaatcatagctggaaacagaatttatttcctctatttgcttcattctgtccttccactatattccctattt

SEQ ID NO: 31420 - DNA, 7923 bp, Homo sapiens
gcgcactcgggcacgcgctcggaagtcgggggtcggcgcggagtgcaggctgctcccggggtaggtgagggaagcgcggaggcggggcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccatcacgttgctaccttacccacacttccctctgatttgcgtgaggacgtggcatcctacttacgtacgtggcataacacatcgtgtgagcccatgtatgctggggtagagcaagtagccctcccctgtctcatcgatccagcagaacctcctcagtctcagtactcttgtttctataaggaaaagttttgctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagctattatgagtgtaggacactgagccatccgtgggtcaggatgcaattatttataaaagtccccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggctggggtggggggaaagaaacctattatcatggacacactggtgctattaattatttcaaatttatatttttgtgtgaatgttttgtgttttgtttatccatgctatagaacaaggaatttatgtagatatacttagtcctatttctagaatgacactctgttcactttgctcaatttttcctcttcactggcacaagtatctgaatacctccttccctcccttctagagttctttggattgtactccaaagaattgtgccttgtgtttgcagcatctccattctctaaattaatataattgctttcctccacacccagccacgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctggcttctcccaggcctcttctactatggcaggagatgtggtgtgctgttgcaaagttttcacgtcatcgtttcctggctagttcatttcattaagtggctacatcctaacatatgcattggtcaaggttgcagcaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaattcttttccttggaattccaactgtggaccttttatatgtgccttcactttagctgtttgccttactctacagccttgctctccggggtggttaataaaatgcaacacttggcatttttatgttataagaaaaacagtattttatttataataaaatctgaatattttgtaacccttta

SEQ ID NO: 31421 - DNA, 1559 bp, Homo sapiens
tagttcaagacaacagagacaaagctaagatgaggaagttctgtacagtttaggaaatagaggctttcaaagataattcgcagtgatgtgaaactggcctcccaagccctgataacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaaaaaaaaaaaaaaaaaaaaaaaaaaaaaa

SEQ ID NO: 31422 - DNA, 1636 bp, Homo sapiens
ggtcttatttatgttgctcaaatgtttacataataacttgtgccaaaaatatagtgctcatgcttttcagttctcacccagaaatgtcctgtggcttctagttgtgtgcctgagatcagataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatggtttaggcattcaagagcccttgggacatatagatttttatccaaatggaggaaataaacaacctggctgtcctaaatcaattttctcaggaattcaattcattaaatgcaaccaccagagagcagttcacttgttcatggcatctttagaaacaaactgcaattttatttcatttccttgtcgttcatacaaagattacaagactagcttatgtgtggactgtgactgttttaaggaaaaatcatgtcctcggctgggttatcaagccaagctatttaaaggtgttttaaaagaaaggatggaaggaagacctcttaggaccactgtgtttttggatacaagtggtacatatccattctgtacctattattttgttctcagtataattgttccagataaaactatgatggatggctcgttttcatttaaattattaaatcagcttggaatgattgaagagccaaggctttatgaaaagaacaaaccattttataaacttcaagaagtcaagattcttgctcaattttataatgactttgtaaatatttcaagcattggtttgacatatttccagagctcaaatctgcagtgttccacatgcacatacaagatccagagactcatgttaaaatcacttacatacccagaaagaccaccactttgcaggtataatattgtacttaaagacagagaggaagtgtttcttaatccaaacacatgtacaccaaagaacacataagatgccttcttccatcaaatgcacttgcttgtgaattaatggacttgtaaatgaaacaatgcaatcagtcttttataatgcactgttcaatttgagattcaagtatttctatttcttggaaaaaattttaagaatcaaaaataaagaaaataaaaaatgcatacagttaaacattccaaa

SEQ ID NO: 31423 - DNA, 2176 bp, Homo sapiens
ctctgtctcaaaaacaaaacaaaacaaaaacagaaagaatcagagtcaacaaatcagtatggatgcagattcctcagatgccaggaatcccaggataaatggcaggggtgaaccaaatacttcccattcttccctcaccaccctcctccatccaataaagaagtaaataaattcctcaagtcccctctgccccagtgcatggaatgtttacctgtggactaggactggtctacatgccaaacaggccttgcctcctgggcggcatgtttgcaggggatccttgctgatgatgttggcctcctcctgcaccctcccactccatggctgtctcacctgagagagctttcttccttttgcattaagtgtgagtcctgataaattcaaaaaagcctccaggtgacatcattttaacaccagttaacaatcacaaatctgggtgaatgagcctcagagtttttcttgacagtagtgtgcgtgcgtgtgtgtgtgcgtgttttccatggaaaaataaaatgtattacacaaactatcagtattaattacagaaaggtggccaggtgcagtgcctcacgcctgtaatcctggcactttgggaggccaaggcgggcagattgcctgagctcaggagtttgagaccagcctggtcaaacatggtgaaaccctgtatctactaaaaatacaaaacattagctgggcgtggtggcgcatgcctgtagtctcaggtactcggaagggtgaggcacaagaatcgcttgagtctggaaggtggaggttgcagtgagccgagaacacgccactaaactccagccggggtgacagagcaagactctgtctcaaaaaacaaacaaacaattaattacagaaaggtaagcctggccaataggtcaggaaaagcagccccactgcagatccacaccactacggaaacttgaggcaccacacacatgactttgctgactgggggcaaaggatgaactagtgagcaaacttgggaggctgagacaggaggatcgcttgaacctgggaggtagaggttgcagtgagccaagatcgcaccactgctctccagccaggtgacagagcgagactccagctcaaaaaaaaaaaaaaagtcaagatattaaatatgaaagcaacactttattttttattttattttattttaagacagggtctctctctgtcacccagactggagtacagtgacatgatctctgctcactgtgatctctgcctcccaggctcaaactatcctcccacatcagcctcccaaatagctgggactacaggggcccaccaccacacctgactaatttttgtatttttggtagagatgcggtttcaccatgttgcccagcctgatcttgaacttctggattcaagtgatccgccctcctcggcctcccaaagtgctgggactacaggcttgagccacctcgcccagctgaaagtgacactttaatactttcaggaaattataggagatgattgttaagagctcaggataaagagaagtttctggccgggaacggtggctcacacctgtaatcccagcactttcagtggcggagcacctgtggccaagagtttgagaccagcctggccaacatggtgaaaccccatctctactaaaaatacaaaaattgaggtgccgctgttgctgctcgtgttaaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctatgatgagcatgtatcctctcgatcacatacagaagaggattgcacggaggagctctttgacttcttgcatgcaaaggaccattgcgtggcccacaaactctttaacaacttgaaataaatgtgtggacttaattcaccccagccttcatcatctgggcatcagaatatttccttatggtttcggatgtaccatttgtttcttatttgtgtaactgtaagttcacatgaacctcgtgggttttggcttaggctggtagcttctatgtaattcgcagtgattccatctaaataaaagttctgtgatctgcaaaaaaaaaaaaaaatt

SEQ ID NO: 31424 - DNA, 2176 bp, Homo sapiens; identical to SEQ ID NO: 31423

SEQ ID NO: 31425 - DNA, 1617 bp, Homo sapiens
gcccggaaaaccatgatctggagaacttggatgttgtcttgtttctctagcaacggtctcaggagcagatggccgcccagcgatttgtctgactgtgttggggctgggccacttgtctccaattcataagggcttgcagcccagttgacccgatgtttcatggaacagtcacagaagagctaaccagtcatgaagaatggagtcactataatgaaaacataagagaaggtcaaaaagattttgtttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagataaagagtctaccaaataccaaattttggaatggattgaagaacctaaaactactctatcttcatgacaatgggtttgcaaagttaaagaatatatgtgtattatctgcctgtccaaccctcattgccctcactatgtttgattgtccagtaagccttaaaaaaggatatagacatgttcttgttaacagtatatggcctctcaaagcgctggatcatcatgtgatttctgatgaagaaataattcagaactggcatcttcctgaaagattcaaagcatgtaaccatcgacttttctttaatttctgcccagctttgagaaaggagaaaatgaagcatagtgaggtttaggaacttacccaatattggacagcaaatgagtcatgaggtgggatttcaacaagtctgcagtcaacattgcatcacaaatgacagacagtgcagagatttgagtgtacttttcacactgagtgtggaaagaggagaagaataagtgtggaaatactcctctactattttgaagctggataactgggacagaaaagaacttatttaacagaaatggcagcacttaaagacttttggtgaaaagataagtttggtcatacttctttgaggcaggatattaaagaagaaataataactagacattggaaatgaaaaacaaaaattcagaaatagtgttctggacttgattgtaaattcaggagtatttgcttggggtcatagttaaagcctagttctctcaggtaaatacagggatcaataaaggctgaaaactaaggacacaaccttggggcactgtctcattttgtgggtagaaagcagtgtaaccaatgaagataaaggataattgatctcagcaggtaagagtaaaaaaaaaattaaatagaaaagaaaaaaacatattggaagaattttttatggtaaagaggatgtcgcatctttagaatttcaatagcttgcagttgttggacatgaaattgtggtgggttatatataactgccaagtatagaacctttactgagaatattttggacagaagaaaaataaagctttaactataggaaatagaatttatgaaagatttattaaagtgaagtggtacttgcctcactttaacttaccaaatatataacttaccatatttataaactgaggataaatgagttttgattagaaagagaaaaaaaaaaaaaaaaaaaaaaaaaaaaa

SEQ ID NO: 31426 - DNA, 1730 bp, Homo sapiens
gcgggccccggctcgctagccgtcctgcgggacgccggcgctgatgggaaatccagttatcaaaattgactcaagaagagagaacctaacagaacaataacaatggaagaaattgggaacattatcacaaagctatcatcctgccaaactccaggctcagatgtcacaggttaaaaaaagtccttcatgaaaaagaaagatcttaagcagcatgatggattcagaagctcatgaaaagaggccaccaatactaacatcttcaaaacaagatatatcacctcatattacaaatgttggtgagatgaagcattacttgtgtggctgctgtgcagccttcaacaatgtcgcaatcacatttcccattcagaaggtcctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagtgcttgcagggacaacagaagcaattttcactccactggaaagagttcagacattgcttcaagaccacaagcatcatgacaaatttaccaacacttaccaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatctggtcaatgattttatctgtggaggtctattgggtgccatgttgggattcttgttttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaggttatatgaaaaaaccatcagttaagtgccatttatcaactgaatagaccttctaagaagaatgcagtttggcctcttttttttttttttttaaaggaaatcccaatcttattatggaaagccatcaactgggtgtggggagtaggtcagagggttagtgaaagtccaggggatttctcctccaagtcctaccacacaaaggaaagtctcaagcctctattcaccccttctcaatcctcacaaaatagggggttgttcaatattgtcttcaatgataaaaactttgtggttaaaagtttctccttaggactagtgacaaagttaggcttatacttttttttttttttgaggcagagtcttgctctgttgcccaggctggagtgcagtggcgcgatcttggctcactgcaacctccgcctccagggttcgggcaattctcctgccttagcctcctgtagtcctagctgctcgggaggctgaggcaggagaatctctttcttaattggccaaatataagttggtgtcgtaactccaggccacagtgagttatgggcaaagcttttttccttaagcatcaacaaaataggataaaaggttccaataggaaaaaaaaaaaaaaaaaaaaaaaaaaaaa

SEQ ID NO: 31427 - DNA, 1785 bp, Homo sapiens
atgacacgtggcaccgggggaactgcccagcgtggaaggtctgggccagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaaaaaaaaaaaaaaaaaa

SEQ ID NO: 31428 - DNA, 1937 bp, Homo sapiens
gtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaaaaaaaaaaaaaaaaaa

SEQ ID NO: 31429 - DNA, 2637 bp, Homo sapiens
atggatctggataaaccatctgtttggggctcattaaaacagcggaccaggccattgttgatcaacttaagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtcttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacattttgactttcactacttctctgacaggatgggcattttggacattgaagtgtggggaaaggacaacaaaaagcatgaggaacgtctgggcacatgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaaccccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggtatttttgatcactgtctggaattttgaactatatatgatccccttggcattgttgctgatctttgtctacaatttcatcagacctgtgaaaggcaaggtcagcagcatccaggacagccaggagagcacagacatagatgacgaggaggatgaagatgacaaggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctag

SEQ ID NO: 31430 - DNA, 616 bp, Homo sapiens
ggcttccgtagcgggagggcgaaagatggcggcggcagtactgggacagttgggtgcgttatggatacataacctgaggagccgggggaagctggccttggggaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaaaaaaaaaaaaaaaa

SEQ ID NO: 31431 - DNA, 735 bp, Homo sapiens
ggcttccgtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaaaaaaaaaaaaaaaaa

SEQ ID NO: 31432 - DNA, 2965 bp, Homo sapiens
cggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaaaaaaaaaaaaaaaaaa

SEQ ID NO: 31433 - DNA, 2544 bp, Homo sapiens
ggactgacctaccgaccattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaaaaaaaaaaaaaaaaaa

SEQ ID NO: 31434 - DNA, 2821 bp, Homo sapiens
aaaggttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcaaaaaaaaaaaaaaaaagtttcca

SEQ ID NO: 31435 - DNA, 2857 bp, Homo sapiens
ttccccatctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcaaaaaaaaaaaaaaaaagtttcca

SEQ ID NO: 31436 - DNA, 5925 bp, Homo sapiens
atgagttctgactctgagatggccatttttggggaggctgctcctttcctccgaaagtctgaaagggagcgaattgaagcccagaacaagccttttgatgccaagacatcagtctttgtggtggaccctaaggagtcctttgtgaaagcaacagtgcagagcagggaaggggggaaggtgacagctaagaccgaagctggagctactgtaacagtgaaagatgaccaagtcttccccatgaaccctcccaaatatgacaagatcgaggacatggccatgatgactcatctacacgagcctgctgtgctgtacaacctcaaagagcgctacgcagcctggatgatctacacctactcaggcttgttctgtgtcactgtcaacccctacaagtggttgccagtgtataatgcagaagtggtgacagcctaccgaggcaaaaagcgccaggaagccccaccccacatcttctccatctctgacaatgcctatcagttcatgctgactgatcgggagaatcagtctatcttgatcaccggagaatctggcgcagggaagactgtgaacaccaagcgtgtcatccagtactttgcaacaattgcagttactggggagaagaagaaggaagaagttacttctggcaaaatgcaggggactctggaagatcaaatcatcagtgccaaccccctactggaggcctttggcaacgccaagaccgtgaggaatgacaactcctctcgctttggtaaattcatcaggatccacttcggtaccacagggaaactggcttctgctgatattgaaacatatcttctggagaagtctagagttactttccagctaaaggctgaaagaagctatcatattttttatcagatcatgtctaacaagaagccagatctaattgaaatgctcctgatcaccaccaacccatacgattatgccttcgtcagtcaaggggagatcacagtgcccagcattgatgaccaagaagagttgatggctacagatagtgccattgaaattctgggctttacttcagatgaaagagtgtccatctataagctcacaggggctgtgatgcattatgggaacatgaaattcaagcaaaagcagcgtgaggagcaagctgagccagatggcactgaagttgctgacaaggcagcctatctccaaaatctgaactctgcagatctgctcaaagccctctgctaccctagggtcaaggtcggcaatgagtatgtcaccaaaggtcaaactgtgcagcaggtgtacaatgcagtgggtgctctggccaaagctgtctacgataagatgttcttgtggatggtcacccgcatcaaccagcagctggacaccaagcagcccaggcagtacttcattggggtcttggacattgctggctttgagatctttgatttcaacagcctggagcagctgtgcatcaacttcaccaatgagaaactgcaacagtttttcaaccaccacatgttcgtgctggagcaggaggagtacaagaaggaaggcattgagtggacgttcattgactttgggatggacctggctgcctgcatcgagctcatcgagaagcctatgggcatcttctccatcctggaagaggagtgcatgttccccaaggcgacagacacctccttcaagaacaagctgtatgaacaacatcttggaaaatccaataacttccagaagcccaagcctgccaaaggcaagcctgaggcccacttctctttgattcactatgctggcaccgtggactacaacattgccggctggcttgacaagaacaaggaccccctgaatgagactgtggtggggctgtaccagaagtctgcaatgaagactctggctctcctctttgttggggcaacgggagcggaagcagaggctggcggtggaaagaaaggtggtaagaagaagggttcttctttccagactgtgtcggctctcttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggtgttaaatgcaagtgctatccctgaaggacaattcatcgatagcaagaaggcttcagagaagctcctggggtccattgacattgaccacacccagtataaatttggtcacaccaaggtctttttcaaagctggtcttctggggctcctagaggagatgcgagatgagaagctggcccagctgattacccgaacccaggccatgtgcagagggttcttggcaagagtggagtaccagaaaatggtggaaagaagagagtccatcttctgcatccagtacaatgtccgtgccttcatgaatgtcaagcactggccctggatgaagctgtatttcaagatcaaacccctcctcaaaagtgcagagacagagaaggagatggccaacatgaaggaagaatttgagaaaaccaaagaagagctggctaagaccgaggcaaaaaggaaagagctggaagaaaaaatggtgactctgatgcaagaaaaaaatgacttgcaactccaggttcaagctgaagctgacagcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcgggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaaggatctttggaacaagaaaagaaaatccggatggatctagaaagagcaaagagaaaactagagggagacctaaaattggctcaagaatccgcaatggatatagaaaatgacaaacaacaacttgatgaaaagcttaaaaagaaagagtttgaaatgagcggtctgcaaagcaagattgaagatgaacaagcccttggtatgcagctgcagaagaaaatcaaggagttacaagcccgcattgaggagctggaggaggaaatcgaggcagagcgggcctcccgggccaaagcagagaagcagcgctctgatctctcccgggagctggaggagatcagtgagaggctggaagaagccggtggggccacctcggcccagattgagatgaacaagaagcgggaagctgagttccagaaaatgcgcagggacctggaggaggccaccctacagcatgaggccacggcggccaccctgaggaagaagcatgcagatagtgtggccgagcttggggagcagattgacaacctgcagcgagtgaagcagaagctggagaaggagaagagtgagatgaagatggagatcgatgaccttgctagtaacatggagactgtctccaaagccaagggaaaccttgaaaagatgtgccgcgctctagaagatcaactgagtgaaattaagaccaaggaagaggagcagcagcggctgatcaatgacctcacagcacagagagcgcgcctgcaaacagaatcaggtgaatattcacgccagctagatgaaaaggacacactagtttcacagctctcgaggggcaaacaagcctttactcaacagattgaggaactgaaaaggcaacttgaagaggagataaaggccaagagtgccctggcacatgccctgcagtcctcccgccatgactgtgacctgctgcgggaacagtatgaggaggagcaggaagccaaggccgagctacagagagcaatgtccaaggccaacagtgaggttgcccagtggaggaccaaatatgagacagatgccatccagcgcacagaggagctggaggaggccaagaagaagctggctcagcgtctgcaggatgctgaggaacatgtagaagctgtgaatgccaaatgtgcttcccttgagaagacgaagcagaggctccagaatgaagttgaggacctcatgattgatgttgagaggacaaatgctgcctgtgccgccctggacaaaaagcaaaggaactttgataagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatctgcagcaggagatttctgatctcactgaacagattgcagaaggaggaaagcgcatccatgaactggaaaaaataaagaagcaagttgagcaagaaaagtctgaacttcaggctgccttagaggaggcagaggcatctcttgaacatgaagagggaaagatcctgcgcatccagcttgagttgaaccaagtcaagtctgaggttgataggaaaattgctgaaaaagatgaggaaattgaccagatgaagagaaaccacattagaatcgtggagtccatgcagagcacactggatgctgagatcaggagcaggaatgatgccattaggctcaagaagaagatggagggagacctcaatgaaatggaaatccagctgaaccatgccaaccgcatggctgctgaggccctgaggaactataggaacacccaagccatcctcaaggatacccagctccacctagatgatgctctccggagccaagaggacctgaaggaacagctggctatggtggagcgcagagccaacctgctgcaggctgagatcgaggaactacgagccactctggaacagacggagaggagcaggaaaatcgcagaacaggagctcctggatgccagtgaacgtgttcagctcctgcacacccagaacaccagcctgatcaacaccaagaagaagctggagacagacatttcccaaatccagggagagatggaagacatcatccaggaagcccgcaatgcagaagagaaggccaagaaggccatcactgatgctgccatgatggctgaggagctgaagaaggaacaggacaccagcgcccatctggagcggatgaagaagaacttggaacagacggtgaaggacctgcagcatcgtctggatgaggctgagcagctggccctgaagggtgggaagaagcagatccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctgcaggacctggtggacaagctgcaagcaaaggtgaaatcctacaagagacaagctgaagaagcggaggaacaatccaacgtcaacctctccaaattccggaggatccagcacgagctggaggaggccgaggaaagggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgcca

SEQ ID NO: 31437 - DNA, 6062 bp, Homo sapiens
tacgggtcctgctttaaaaagctccaagaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccagggggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaagcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggcggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcagagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaggcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaaaaaaaaaaaaaaaaa

SEQ ID NO: 31438 - DNA, 6032 bp, Homo sapiens
gaattccgtgggcggaggtctgggatctcctggctgttgctgtcttctgctctcatcctgcaggtgggactctcagctgacaccatgagtagtgacactgaaatggaagtgttcggcatagctgctcctttcctccggaagtcagaaaaggagaggatcgaggctcagaaccagccctttgatgccaagacgtattgcttcgtggtggactcaaaggaagaatatgccaaggggaaaatcaagagttctcaggatgggaaggtcactgtggaaactgaggacaacaggaccctggtggtcaaaccagaggatgtgtacgccatgaacccccccaagttcgacaggatcgaagacatggccatgctgacgcacctgaatgagccagccgtgctgtacaacctgaaggaccgttacacatcttggatgatctatacctactcaggcctcttctgtgtcactgtcaacccctacaagtggctgccggtgtacaaccccgaggtggtggaaggctaccgaggcaaaaagcgccaggaggccccaccccacatcttctccatctctgacaacgcctatcagttcatgctgactgatcgtgaaaaccagtccattctgatcacgggagaatccggggcaggaaagactgtgaacaccaaacgggtcatccagtactttgcaacaattgcagctactggggacctggccaagaagaaggactccaaaatgaaggggactctggaagatcaaatcatcagtgccaatcccctgctggaggcctttgggaacgccaagactgtgaggaatgacaactcctcccgttttggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatcgagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggcagaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggagattttaaacaaagataccgagtgctgaatgccagtgcaatcctggagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcggagactgagaaagagatggccaccatgaaggaagaattccagaaaaccaaagatgaactcgccaagtcggaggcaaagaggaaggagctagaggaaaaactggtgactctggtccaagagaaaaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacggagaacaaggttaaaaaccttactgaggaactctccgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgcgtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggctgagttcctgaagctgcgcagggacctggaggaggccacactgcagcacgaagccatggtggccacgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggcccaagaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaagaagccaagatcctccgaatccagcttgaattgacacaagtgaaatcagaaattgatagaaagattgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccgaggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagaagaagaacacagagtctgttaagggcctgaggaagtatgagcggagggtcaaggagctgacgtaccagagtgaagaggacaggaagaatgtgctgagattgcaggatctggtggataaactgcaagtgaaagtcaagtcctacaagaggcaggcggaggaggctgatgaacaagccaatgctcatctcaccaaattccggaaagctcagcatgagctggaggaggccgaggaacgtgcggatatcgcagaatctcaagtcaacaagctccgcgctaagactcgagacttcacctccagcaggatggtggtccacgagagtgaagagtgagccagcccttctggagcaggagcaggacagaagatatgcaaaatgtatattttcttgattcctgaccattgatacttaatgtccatgtgactctttttcacatgcaataaactttgctttgtttc

SEQ ID NO: 31439 - DNA, 6016 bp, Homo sapiens
atccttcctcaaaattcttgaagtagttgtctgctttgagcctgccaccttcttcatctgataatacaagaggtatacctagtccagcactgccatcaataacctgcagccatgagttctgactctgagatggccatttttggggaggctgctcctttcctccgaaagtctgaaaaggagcgaattgaagctcagaacaagccttttgatgccaagacatcagtctttgtggtggaccctaaggagtcctacgtgaaagcaatagtgcagagcagggaaggggggaaggtgacagccaagaccgaagctggagctactgtaactgtgaaagaagaccaagtcttctccatgaaccctcccaaatatgacaagatcgaggacatggccatgatgactcacctgcatgagcctgctgtgctgtataacctcaaagagcgttacgcagcctggatgatctacacctactcgggcctcttctgtgtcaccgtcaacccctacaagtggctgccggtgtacaaccctgaggtggtgacagcctaccgaggcaaaaagcgccaggaggccccaccccatatcttctccatctctgacaatgcctatcagttcatgctaactgatcgtgaaaaccagtcaatcttgattactggagaatctggtgcagggaagactgtgaacacgaagcgtgtcatccagtactttgcaacaattgcagttactggagagaagaaaaaagaggaacctgcctctggcaaaatgcaggggacccttgaagatcaaatcatcagtgctaaccccctactggaagccttcggcaatgccaagaccgtgaggaatgacaactcctctcgctttggtaaattcatcaggatccattttggtgccacaggcaaactggcttctgcagatattgaaacatatctgctagagaagtcccgagttacttttcagctaaaggctgaaagaagctaccacatattttatcaaatcctgtccaataagaaaccagagctcattgaaatgcttctgatcaccaccaacccatatgacttcgcatttgtcagccaaggggaaattactgtgcccagcattgatgaccaggaagagctgatggccacagatagtgctgtggacatcctgggtttcactgctgatgaaaaggtggccatttacaagctcactggagccgtgatgcattatgggaacatgaaattcaagcaaaagcaaagggaagagcaggcagagccagatggcacggaagttgctgacaaagctgcttatctgacaagtctgaactctgctgacctgctcaaatctctctgctatcccagagtcaaggtcggcaatgagttcgtaaccaaaggccagactgtgcagcaggtgtacaacgcagtgggtgctctggccaaagccatctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaacgagaaactgcaacagtttttcaaccaccacatgttcgtgctggagcaggaagagtacaagaaggaaggcatcgagtgggagttcattgacttcgggatggacctggctgcctgcatcgagctcatcgagaagcctatgggcatcttctccatcctagaagaggagtgcatgttccccaaggcaacagacacctccttcaagaacaagctgtatgaacaacatcttggaaaatccaacaacttccagaagcccaagcctgccaaaggcaagcctgaggctcacttctcactggtgcactatgccggcaccgtggactacaacatcgccggctggctggacaaaaacaaggaccccctgaatgagactgtggtggggctgtaccagaagtctgcaatgaagactctggctttcctcttctctggggcacaaactgctgaagcagagggtggtggtggaaagaaaggtggcaaaaagaagggttcttctttccagacagtgtcagctcttttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggttctaaatgcgagtgctatcccagagggtcagttcattgacagcaagaaggcttctgagaaacttctagggtctattgaaattgaccacacccagtacaaattcggtcataccaaggttttcttcaaagctggcctgctgggaactctagaagaaatgcgagatgaaaagctagctcaactcatcacgcgcactcaagccatatgcagggggttcctgatgagagtggagttcagaaagatgatggagaggagagagtccatcttctgcattcagtacaacatccgtgctttcatgaatgtgaagcactggccctggatgaagctgtatttcaagatcaagcccctcctcaagagtgcagagacagagaaggagatggccaacatgaaggaagaatttgagaaaaccaaagaagagctggctaagacagaggcaaaaaggaaagaactagaagaaaagatggtgacgctaatgcaagagaaaaatgacttacaactccaagttcaagctgaagcagatgccttggctgatgcagaggaaagatgtgatcagttgattaaaaccaaaatccaacttgaggccaaaatcaaagaggtaactgaaagagctgaggatgaggaagagatcaatgctgagctgacagccaagaagaggaaactggaggatgaatgttcagagctcaagaaagacattgatgaccttgagctgacactggccaaggttgagaaggagaaacatgccacagagaacaaggtgaaaaacctcacagaagagatggcaggtctggatgaaaccattgctaagctgaccaaggagaagaaggctctccaggaggcccaccagcagaccctggatgacctgcagatggaggaggacaaagtcaacaccctgaccaaagctaaaaccaagctagaacagcaagtggacgatcttgaaggatctctggaacaagaaaagaaactttgcatggacttagaaagagccaagagaaaactggagggtgacctaaaattggcccaagaatccacaatggatacagaaaatgacaaacagcaacttaatgagaaactcaaaaagaaagagtttgaaatgagcaatctgcaaggcaagattgaagatgaacaagcccttgcaatgcagctacaaaagaagatcaaagaattacaggcccgcattgaggagctggaggaggaaatcgaggcagagcgggcctcccgggccaaagcagaaaagcagcgctctgacctctcccgggagctggaggagatcagtgagaggctggaagaagccggtggggccacttcagcccagattgagttgaacaagaagcgggaggctgagttccagaaaatgcgcagggacctggaagagtccaccctgcagcacgaagccacggcagctgctcttcggaagaagcacgcagatagtgtggctgagcttgggaagcagatcgacagccttcagcgggtcaagcagaagctggagaaggaaaagagtgagctgaagatggagatcaatgaccttgctagtaacatggagactgtctccaaagccaaggcaaactttgagaaaatgtgccgcaccctagaggaccagcttagtgaaataaaaacaaaggaagaagagcagcaacgcttaataaatgagttgtcagcccagaaggcacgtttacacacagaatcaggtgagttttcacgacagctagatgaaaaagatgctatggtttctcagctatcccgaggcaaacaagcatttacacaacagattgaagaattaaagaggcagctagaagaggagactaaggccaagagcactctggcccatgccctgcagtcagcccgccatgactgtgacctgctgcgggaacagtatgaggaggagcaggaagccaaggctgagctgcagaggggaatgtccaaggccaacagtgaggttgcccagtggaggaccaagtacgagacggacgccatccagcgcacagaggagctggaggaggccaagaagaagctagcccagcgtctgcaggatgcagaagaacatgtagaagctgtgaattccaaatgtgcttctcttgaaaagacaaagcagaggctacagaatgaagtagaggacctcatgattgatgtggaacgatctaatgctgcctgcatagctctcgataagaagcaaagaaactttgacaaggttctggcagaatggaaacagaagtatgaggaaactcaggctgaacttgaggcctcccagaaggagtcgcgttctctcagcactgagctgttcaaggtgaagaatgcctacgaggaatccctggatcatcttgaaactctaaagcgagagaataagaacttacaacaggagatttctgacctgacagagcaaattgcagagggtggaaagcatatccatgaactggagaaagtaaagaaacaacttgatcatgagaagagtgaactacagacttccctagaggaagcagaggcatctcttgagcatgaagaaggcaaaattcttcgcattcaacttgagctaaatcaggtgaaatctgagattgaccgaaaaattgctgaaaaagatgaagaactcgatcagctaaagaggaaccatctcagagttgtggagtcaatgcagagtacactggatgctgagatcaggagcagaaatgatgctctgaggatcaagaagaagatggagggagatcttaatgaaatggaaatccagctgaaccatgccaaccgccaggctgctgaggcactaaggaatcttagaaacacacaaggaatactgaaggacactcagctacatttggatgatgccatcagaggccaagatgaccttaaggaacaattggcaatggttgagcgcagagctaacctgatgcaggctgaagttgaagagctcagggcatccctggaacggactgagagaggcaggaaaatggcagagcaagagcttctggatgccagtgaacgtgtgcaacttctgcacactcagaacaccagcctgatcaacaccaagaagaagctggaaacagacatttcccaaatccagggagagatggaggacatcgtccaggaagcccgcaatgcagaggagaaggccaagaaggccatcactgatgctgccatgatggctgaggagctgaagaaggaacaggacaccagcgcccacctggagcggatgaagaagaacatggagcagaccgtgaaggatctgcagctccgtctgggtgaggctgagcagctggcgctgaagggtgggaagaagcagatccagaaactggaggccagggtgagagagcttgaaagtgaggtggaaagtgaacagaagcacaatgttgaggctgtcaagggtcttcgcaaacatgagagaagagtgaaggaactcacttaccagactgaggaggaccgcaagaatattctcaggctgcaggacttggtggacaaattgcaaaccaaagtcaaagcttacaagagacaagctgaagaggctgaggaacaatccaatgtcaaccttgccaagttccgcaagctccagcacgagctggaggaggccgaggaacgggctgacattgctgagtcccaagtcaacaagctgagagtgaagagtcgggaggttcacacaaaagtcataagtgaagagtaattcattctaatgaaagaaaatgtgaccaaagaaatgcacgaaatgtgaagttctttgtcactgtcctgtatatcaaggaaataaa

SEQ ID NO: 31440 - DNA, 6016 bp, Homo sapiens
gtggaacacttctgaacctgcatttttatctggaactccagaagcagaatcctttgctaaataaatcgcagccatgagtgcgagctcagacgctgagatggctgtttttggcgaagctgctccctaccttcgaaaatcagaaaaggagcggattgaggcccaaaacaagccgtttgatgctaaaacatctgtctttgtggcggagcccaaggaatcctatgtgaagagcactatacaaagcaaagaaggagggaaagtaaccgtaaagactgaaggtggagcaactctaactgtcagggaagaccaagtcttccctatgaaccctccgaaatatgacaaaattgaggacatggccatgatgactcatctacacgagcctggagtgctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgttgactgatcgagagaatcagtccatcctgatcaccggagaatctggtgccggaaagactgtgaacaccaagcgtgtcatccaatactttgcaacaattgcagttactggagagaagaagaaggatgaatctggcaaaatgcaggggactctggaagatcaaatcatcagcgccaatcccctactggaggcctttggcaatgccaaaaccgtgaggaatgacaactcctctcgctttggtaaattcattagaatccactttggtactacagggaagctggcatctgctgatatagaaacatatcttttagaaaagtccagagttactttccagctaaaggcggaaagaagctaccatattttttatcagatcacttccaataagaagccagatctaattgaaatgctcctgatcaccaccaacccatatgactatgccttcgtcagtcagggggagatcacagttcccagtattgatgaccaagaagagttgatggccactgatagtgccattgacatcctgggcttcactcctgaagagaaagtgtccatctataaactcacaggggctgtgatgcattatgggaacatgaaattcaagcaaaagcagcgtgaggagcaagctgagccagatggcacagaagtcgctgacaaggcagcctatctccagagtctgaactctgcagacctactcaaagccctctgctaccctagggtcaaggttggcaatgagtatgtcaccaaaggccagactgtgcagcaggtgtacaatgccgtgggtgctctggccaaagccgtctacgagaagatgttcctgtggatggtcacccgcatcaaccagcagctggacaccaagcagcccaggcagtacttcatcggggtcttggacattgctggctttgaaatctttgattttaacagcctggagcagctgtgcatcaacttcaccaacgagaaactgcaacagtttttcaaccaccacatgtttgtgctagagcaggaggagtacaagaaggaaggcatcgagtggacgttcattgactttgggatggacctggctgcctgcattgagctcattgagaagccactgggcatcttctccatcctggaagaggagtgcatgttccctaaggccacggacacctccttcaagaacaagctgtatgaccagcacctgggcaagtctgccaacttccagaagcccaaggtggtcaaaggcaaggctgaggcccacttctctctgattcactatgctggcactgtggactacaacattactggctggctggacaaaaataaggaccccctgaatgatactgtggttgggctgtaccagaagtctgcaatgaagactctagccagtctcttttccacgtatgctagtgctgaagcagatagcagcgcgaagaaaggtgctaagaaaaagggctcttctttccagactgtgtctgcccttttcagggaaaatttaaataaattgatgacgaatctgaggagcacacaccctcacttcgtacggtgtatcattcccaatgaaaccaaaactcctggggcaatggaacatgaacttgtgttgcaccagctgaggtgtaatggtgtgctggaaggcatccgcatctgtaggaaaggattcccaagcagaatcttatatggtgatttcaaacaaagatacaaggttttaaatgcaagtgctattccagagggacagttcattgacagcaagaaggcttctgagaaacttcttgcatctattgatattgatcatactcaatataaatttggacataccaaggttttcttcaaagctggacttctgggtcttctggaagaaatgagagatgaaaaattagcccaaattataacaagaacacaagctgtctgtaggggattcctaatgagggtagaatatcagaagatgttgcaaaggagagaagcacttttctgcatccagtataatgtccgtgccttcatgaacgtcaagcactggccctggatgaaactctttttcaagattaagcccctcctcaagagtgcagagaccgagaaagagatggccaccatgaaggaagaattccagaaaaccaaagatgaactcgccaagtcagaggcaaaacggaaggagctagaggaaaaaatggtcactctcttaaaagagaaaaatgacctgcaactccaggttcaatctgaagcagatagcttggctgatgcagaggaaaggtgtgagcaactgattaaaaacaaaatccaacttgaggccaaaatcaaagaggtgactgaaagagctgaggaggaggaagagatcaatgctgagctgacagccaagaagagaaaactggaggatgaatgttcagaactcaagaaagacattgatgaccttgagctgacactggccaaggttgagaagcagaaacatgccacggagaacaaggtgaaaaatcttacagaagagatggcaggcctggatgaaaccattgcaaaactgtccaaggagaagaaggctctccaagagacccaccagcagaccctggatgacctgcaggcagaggaggacaaagtcaacatcctgaccaaagctaaaaccaagctagaacagcaagtggatgatcttgaagggtctctggaacaagaaaagaagcttcgaatggatctagaaagagcaaagcggaaactggagggtgacctcaaattggcccaagaatccacaatggatatggaaaatgacaaacagcaacttgatgaaaagcttgaaaagaaagaatttgaaatcagcaatttgataagcaaaattgaagatgagcaagctgtagaaattcaactacagaagaagatcaaagagttgcaggcccgcattgaggagctgggggaagaaatcgaggcagagagggcgtcccgagccaaagcggagaagcagcgctctgacctctcccgggaactggaggagatcagcgagaggctggaagaagccggtggggcaacttctgctcaggtggaattgaacaagaagcgggaggctgagtttcagaaactgcgcagggacctggaggaggccaccctgcagcatgaagctatggtggctgctcttcggaagaagcacgcagacagtatggctgagcttggggagcagattgacaacttgcagcgggtcaaacagaagctggagaaggagaagagtgagctgaagatggagactgatgacctcagcagtaacgcagaggccatttccaaagccaagggccaccttgaaaagatgtgccgctctctagaagatcaagtgagtgggcttaagaccaaggaagaggagcagcagcggctgatcaatgacctcacagcacagagagcgcgcctgcagacagaagcgggtgaatattctcgacaattagatgagcaagatgctttagtctctcagctttcaaggagcaagcaagcatctactcagcagattgaagagctgaaacatcaactagaggaagaaactaaagccaagaacgccctggcacacgccctgcagtcctcccgccatgactgcgacctgctgcgggaacagtatgaggaagagcaggaaggcaaagctgagctgcagagggcgctgtccaaggccaacagtgaggttgcccagtggagaaccaaatacgagacggatgccatccagcgcacagaggagctggaggaggccaagaaaaagttggcccagcgcctgcaagaagctgaggaacatgtagaagctgtgaacgccaaatgtgcttcccttgagaagacgaagcagcggctccagaatgaagttgaagacctcatgcttgatgtggaaaggtctaatgcagcctgtgcagcccttgataagaagcaaaggaactttgacaaggtcctatcagaatggaagcagaagtatgaggaaactcaggctgaacttgaggcctcccagaaggagtcacgttctcttagcactgagctgttcaaggtgaagaatgtctatgaggaatccctggatcaactcgaaacgctaagaagagcacataagaacttgcaacaggagatttctgacctcactgagcagattgcagagggaggaaagcaaattcatgaattggagaaaataaagaagcaagtagaacaagagaaatgtgaaattcaggctgctttagaggaagcagaggcatctcttgaacatgaagaaggaaagattctgcgtatccagcttgagttaaaccaagtcaagtctgaagttgatagaaaaatcgcagaaaaggatgaggaaattgaccagctgaagagaaaccacactagagtcgtggagacaatgcagagcacgctggatgcagagattagaagcagaaatgatgctctgagagtcaagaagaaaatggaaggagatctgaatgaaatggaaatccagctgaaccatgccaatcgcttagctgcagagagtttaaggaactacaggaacacccaaggaatcctgaaggaaacccagctccacctggatgatgctctccggggccaggaggacctcaaggaacagctggcaattgtggagcgcagagccaacctgctgcaggctgagatcgaggagctgtgggccactctggaacagacagagagaagcaggaaaatcgccgaacaggagctcctggatgccagtgagcgtgtccagctcctccacacccagaataccagtctcattaacaccaagaagaaattagaaaatgacgtttcccaactccaaagtgaagtggaagaagtaatccaagaatcacgcaatgcagaagagaaagccaagaaggccatcactgatgctgccatgatggctgaggagctgaagaaggaacaggacaccagcgcccacctggagcggatgaagaagaacctggagcagacggtgaaggacctgcagcatcgtctagatgaggccgagcagctggcgctgaagggtgggaagaagcagatccagaaactggaggccagggtacgtgagcttgaaggagaggttgaaaatgaacagaaacgtaatgcagaggctgttaaaggtttacggaaacatgaccgacgagtaaaagaactcacctaccagactgaagaagatcgcaagaatgttctcaggctgcaggacttggtagataaattacaggcgaaggtgaaatcatacaagagacaagctgaggaggctgaggaacaatccaatgctaatctatctaaattccgcaaactccagcatgagctggaggaggccgaggaacgggctgacattgctgagtcccaggtcaacaaattgcgagtgaagagccgagaggttcacacaaaaatcagtgcagagtaaacacacctgcctgatgctatcaagaggctgaagaaaggcacaaaatgtgctatttttggtcacttgctttatgacgtttattttcctgttaaagctgaataaataaaaactacagtaaatgtatacatt

SEQ ID NO: 31441 - DNA, 570 bp, Homo sapiens
actgaggggtcagtggttccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaaaaaaaaaaaaaaaaaaaaaaaaaaaaa

SEQ ID NO: 31442 - DNA, 2424 bp, Homo sapiens
cctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatggaagcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagaygaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaggaaaagaggaagactggacaaaacaacacaaaggcagaaaggaaagaaactgaagaaagaagataatagaccagcaattgcagcacttacaatcactaattcccttaaggttaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagagatgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagagggcaagtgcaatttattaaatttatattcttaaagggggaattcatggattattaaggtccttcaggcccttggggactctta

SEQ ID NO: 31443 - DNA, 1825 bp, Homo sapiens
agagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagctgtgccaaaggtcaagctgctgtgtggggcagatttattggagtcctttgctgttcccaatttgtggaagagtgaagacatcacccaaatcgtggccaactatgggctcatatgtgttactcgggctggaaatgatgctcagaagtttatctatgaatcggatgtgctgtggaaacaccggagcaacattcacgtggtgaatgaatggatcgctaatgacatctcatccacaaaaatccggagagccctcagaaggggccagagcattcgctacttggtaccagatcttgtccaagaatacattgaaaagcataatttgtacagctctgagagtgaagacaggaatgctggggtcatcctggcccctttgcagagaaacactgcagaagctaagacataggaattctacagcatgatatttcagacttcccatttggggatctgaaacaatctgggagttaataactggggaaagaagttgtgatctgttgcctaaactaaagcttaaaagtttagtaaaaatcgtctgggcacagtggctcacgcctgtagtcccagctacttgggaggctgaggcaggagaatcacttgaccccaggtggtggaggttgcagtgagccaagattgcaccattgcactccagcctggcgacagagcaagactctgtctcaaaaaaaaaaaaaaaatttagtaaaaatcaatggtaagctaaaataagtttttgtttgtttatttgtttttgagatggagtctctactaaaaatacaaaaaattagccaggcatggtgccgcataactataatcccagctacttgggaggctgaggcaggagaatcgcttgaacccgggaggcacaggttccagtgggccaaggttgtgccactgcactccagcctgggcaaaaaagcaaaactccatctcaaagagaaaaaaaaaaaagaccgggtgtggtggctcacacctgtaatcccagcactttgggaggcctaagtgggtggatcacgtgaggtcaagagttcaagaccagcctggccaatatggtgaaaccccatctctactaagaatacaaaaaattagctgagcatggtggtgggctcctgtagtcccagctacttgggaggctgaggcaggagaatcgcttgaacctgggaggcagaggttgcagtaagccaagatcgtgccattgcactccagcctgggtgacagagcgagactccatctcaaaaaaaaaaaaaaaaaaaa

SEQ ID NO: 31444 - DNA, 3067 bp, Homo sapiens
agccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggtgtgtgcaggctctctatgggatgccgccatcagaatgtctcttcctcagcccctttgttttttaaagtggctttggtcgaccatttgctctgtgcttggtactgtgtcaagggcccgattgaagaccacagatcctaaagataggggagtgtcgcgacaaggctgcctggggtgccctcttaacccaggggatcagtaaccctgtgctgagtcaatatccaaaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgaaa

SEQ ID NO: 31445 - DNA, 2765 bp, Homo sapiens
agccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtg

SEQ ID NO: 31446 - DNA, 2346 bp, Homo sapiens
agccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgaaa

SEQ ID NO: 31447 - DNA, 2309 bp, Homo sapiens
agccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgaaa

SEQ ID NO: 31448 - DNA, 2379 bp, Homo sapiens
agccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtg

SEQ ID NO: 31449 - DNA, 2838 bp, Homo sapiens
agccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtg

SEQ ID NO: 31450 - DNA, 4065 bp, Homo sapiens
gggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaaaaaaaaaaa

SEQ ID NO: 31451 - DNA, 3876 bp, Homo sapiens
gggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaaaaaaaaaaa

SEQ ID NO: 31452 - DNA, 3986 bp, Homo sapiens
gggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaaaaaaaaaaa

SEQ ID NO: 31453 - DNA, 3755 bp, Homo sapiens
gggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaaaaaaaaaaa

SEQ ID NO: 31454 - DNA, 3653 bp, Homo sapiens
gggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaaaaaaaaaaa

SEQ ID NO: 31455 - DNA, 13094 bp, Homo sapiens
gggacgaagcgggcccgccagcgagtcgcagtcccaggagccgagctccagcactagagccagctgcgagcggagggcaccaactccgcagaactggcttttcaatgggacacctgtggctcctgggtatttggggcctctgtgggctgctcctgtgtgccgcggatcccagcacagatggctctcaaataatccccaaagtcacagaaataatacctaaatatggcagtataaatggagcaacaaggctgactataagaggggaaggtttttctcaagcaaaccagtttaactatggagttgataacgctgagttgggaaacagtgtgcaattaatttcttctttccagtcaattacttgtgatgtagaaaaagatgcaagtcattcaactcaaattacatgctatactagagcaatgccggaagattcctacactgttagagtcagtgtggacggggttcctgttacggaaaataacacctgcaaaggtcacatcaacagctgggaatgtaccttcaacgcaaaaagttttagaaccccaacaataagaagcatcacacctttatctggaactccaggtacactaataacaatccaaggcagaatcttcactgatgtctatggaagtaatattgcactaagctcaaatgggaaaaatgttaggattttgagagtttacattggaggaatgccctgtgagcttctcataccacaatctgataatttatatggtctaaaactggatcatccaaatggagatatgggttctatggtttgtaagacgactggaacttttattggtcatcacaatgtcagcttcatcttagataatgattatggaaggagttttccacagaaaatggcatattttgtttcttctctcaataaaattgcaatgtttcaaacatatgcagaggtcaccatgattttcccttcacaaggaagcattcgaggtggcaccacgctgacaataagtgggcgtttctttgatcagacagatttccccgtcagagttctagttggaggtgaaccttgtgatattttgaatgtcacagaaaatagtatatgttgcaagacaccccccaaacctcatattctcaaaactgtatatccaggagggagaggcctgaagcttgaggtgtggaataatagccgtccaatacgtttggaagagatactggaatacaatgaaaaaacgcctgggtacatgggtgccagttgggtagattcagcttcctatatttggctcatggaacaagacacatttgttgcacgctttagtggatttttggtggctccagattctgatgtttatagattctacatcaagggtgatgaccgttatgctatttattttagccagactggacttccagaagataaggtgaggattgcatatcattctgctaatgccaacagttatttttccagtccaacacaaagatcagatgatattcatctgcagaaaggaaaagaatactatattgaaatcttgctgcaggagtacagattaagtgcatttgttgatgttggactgtaccagtatcgaaatgtttatactgaacaacaaacaggagatgcagtgaatgaagaacaagttatcaaatcccagtcgacaatcctccaggaagtacaggttataacattggaaaactgggaaacaactaatgcaattaatgaggttcagaagatcaaggtaaccagcccatgtgtggaagctaattcatgttcactttaccaatatagattaatctataatatggaaaaaactgtcttcctacctgctgatgcttctgaattcatactgcaatcagccttgaatgacctctggtctataaaaccggacacagttcaagtaataagaacacaaaatccccagagctatgtctacatggtaacattcatatcaactagaggagactttgatctgcttggttatgaagtagttgaagggaataatgtcacactggatattacagaacaaaccaaaggaaaacccaacttggagacattcacactgaattgggatgggatcgcttctaagccactcactctatggtcatcagaagctgaatttcagggagcagtggaagaaatggttagcactaagtgtccaccacaaattgcaaattttgaagaaggatttgttgtgaaatatttcagagactatgaaactgattttaatctggaacatattaacagagggcagaagacagctgaaaccgatgcttactgtggtcgttattccctgaaaaacccagctgttctttttgactcagcagatgttaaaccaaacagacgaccatatggagatattttattgtttccttataatcagttatgtttagcatacaaaggattcctggcaaattatattggtctaaaatttcagtaccaagacaatagcaagattactagaagcactgatacacagtttacatacaactttgcttatggaaacaactggacttacacttgcatagaccttctggatctcgtaagaacgaaatacactgggacaaatgtttctcttcagaggattagcttacataaagcatcagaatcacagtccttctatgtggatgtagtgtacattggacacacatctacaatctcaacattggatgaaatgcccaagagaagacttcctgcattagcaaataaaggaatattcttagagcactttcaggtgaatcagaccaaaacaaatgggccaactatgacaaaccaatattctgttaccatgacttcatacaattgcagttacaatatacccatgatggctgtgagctttgggcagataatcacacatgagacagagaacgagtttgtctacagaggaaataattggccaggcgagtcaaaaattcatattcaaagaattcaagctgcatctccacctctaagtggcagctttgacattcaagcttatggacatattcttaaaggcctccccgctgctgtgtcagctgcagatctgcagtttgcactccagagtctggagggaatgggaagaatctcagttacacgagagggaacctgtgctggctacgcgtggaacatcaaatggagaagcacctgcggaaagcagaatcttctacagattaatgattccaacattattggagaaaaggctaatatgacagttacaaggataaaggaaggtggcttattcagacaacatgtacttggagacctacttcgtacacccagtcaacagccacaggttgaagtctatgtcaatggaattccagctaaatgttcaggtgactgtggatttacatgggattccaacattactcccctagtcttggcgataagcccttctcaagggtcctatgaagaaggcacaattctaaccatagtgggttctggattttctcctagttcagctgtaacagtctcagttggaccagtaggttgttctcttctttctgtggatgaaaaagagctcaagtgccagattctgaatggaagtgctggacatgcccccgttgctgtgtccatggctgatgttggactagcacagaatgtagggggtgaagagttctactttgtttatcagagtcagatctcacatatctggcctgattctggaagcatagcaggtggtactctactgactttatctggatttggctttaatgaaaattcaaaggtattagttggaaatgaaacctgcaatgtgattgaaggggatttgaataggataacctgcaggacaccaaaaaaaactgagggtacagttgatatttcagttactaccaatggatttcaagccacagcaagggatgcttttagttataattgtttacagacaccaattataactgattttagtccaaaagtacgaacaatactaggagaagttaatttaacaattaagggctataattttggaaatgaactcacacaaaacatggcggtgtatgttggaggaaaaacctgccagattcttcactggaacttcacagatattagatgccttttgcccaagttgtctcctggaaaacatgatatctatgtagaagtcagaaactggggttttgcatcaacaagagacaaattaaattcttcaatacagtatgttttagaagtgaccagcatgtttccacaaagaggctccttgtttggtggaactgaaatcaccataaggggttttggattcagcacaataccagctgagaataccgtgctgttagggtccatcccttgcaatgttacatcatcatcagaaaatgtcataaaatgtattcttcattcaactgggaatatattcaggattaccaacaatgggaaagattcagtacatggattaggttatgcctggtcaccaccagtcctaaatgtgtctgtgggggacacagtggcatggcattggcaaacacatccgtttcttagagggataggatataggattttttctgtctccagtcctggaagtgtaatttatgatggcaaaggattcacaagtggaagacaaaaatctacatcaggttcattttcttaccaatttacttctcctggaatccattattatagcagcgggtatgttgatgaggctcactccatttttctccaaggagtcattaatgttttaccagctgaaaccagacacattcccttgcacctgtttgtgggtcgctctgaagccacatatgcttatggaggacctgagaatttgcacttgggaagctctgtggcaggctgcctagcaacagaacccctgtgcagcctgaacaataccagggttaaaaattcaaaaagattgctatttgaggtttcaagttgtttttcaccatctataagcaacattactccgtccactggaacagtaaatgaactaataacaattattggacatggctttagtaatctcccatgggctaataaggttacaattggtagctacccctgtgtcgtagaagaaagtagtgaggattcaattacatgtcatattgaccctcaaaactcaatggatgttggtatcagggaaactgtcactttgactgtctacaacctgggcactgctatcaatacgttgtccaatgaatttgataggcgatttgtacttttgccaaacattgacctggtgttgccaaatgcaggatcaactacaggaatgacaagcgtgaccataaaaggctctggatttgccgtttcttctgcaggtgtaaaagtccttatgggtcatttcccatgtaaagttctatcagtgaattatacggccattgaatgtgaaacatcccctgctgcccaacagcttgtggatgtagatcttctaatacatggagtgcctgcccagtgccagggaaactgcaccttttcatacttagaaagcatcactccttacataacaggagtcttcccaaactctgtcataggatctgtaaaagttcttattgaaggagaaggtttggggactgttttggaggacattgctgttttcattggaaatcaacagttcagagcaatagaggttaatgaaaacaacatcactgctcttgtgactcctctcccagttggacatcattctgttagtgttgtggtgggaagtaaaggcttggctctgggaaacctgactgtcagcagccccccagtagcatctctatcaccaacttctggaagcattggtggtggaactacactggtgatcacaggaaatggcttctatccaggcaacactacagtcactattggggatgaaccttgtcaaattatttccatcaaccccaatgaagtctactgccgcactcccgctgggaccactggaatggtcgatgttaaaatctttgttaatacaattgcttatccacctttgctttttacatatgccctggaggatactccatttctcagaggaattatcccaagcagaggtccaccaggaactgaaattgagatcactggatccaactttggctttgagatcttggaaatctccgtgatgataaataacattcagtgtaatgtaaccatggccaatgatagtgtgttgcagtgcatcgtgggagatcatgctgggggcacatttcctgttatgatgcatcataagacaaaaggctcagccatgtccacagttgtatttgagtacccgcttaatattcaaaatattaatccaagccaagggagctttggtgggggtcaaaccatgactgtgacaggcaccggatttaatccacaaaattcaattatattagtttgtggctcagaatgtgcaattgacaggcttagatctgattacacaacactattatgtgaaattccatctaataatggcacgggagctgagcaagcctgtgaagtgagtgtggttaatgggaaagatttgtcacagtccatgactccgtttacgtacgcagtgtcactgactccactcatcactgcagtatctcctaagagaggcagtacagcagggggcaccagactgacagtcgtgggatcaggattcagtgaaaatatggaggatgttcatatcaccatagctgaagccaaatgtgatgttgagtattccaacaagacacacatcatctgcatgacagatgcccatactctatcagggtgggctccagtttgtgtccacatcagaggtgtcggcatggccaaactggataatgctgactttctttatgttgatgcctggtcctccaatttctcatgggggggaaaatctcccccagaagaaggatctcttgttgttattacaaaaggacagaccattctcctggatcaaagcacccctattttgaaaatgttgcttattcagggtgggactctaatatttgatgaagctgacattgaactccaggcagaaaatattctaattacagatggaggtgttcttcagattggaacagagacatccccattccaacacaaggctgtcattaccttgcatggtcacctgcgatctcctgagctccctgtctatggtgccaaaacactggctgtgcgggagggaatcctggatctgcacggtgtgcctgttcctgtgacctggactcgcttggctcatactgcaaaggcaggggaaagaattttaattttacaagaagcagtaacatggaaaccaggagataacattgtaattgcaagcacaggacacagacacagtcaaggagagaatgaaaaaatgaccattgcatctgtgtctgctgatggcataaacataacactaagtaacccactaaattacacacacttaggaattacggtcacactccctgatggaactctgtttgaagcaagagcagaagttggaattcttacaagaaatattttaataagaggatctgataatgttgagtggaataacaaaattcctgcatgtcctgatggatttgacacaggagaatttgctacacagacctgtctccaaggaaagtttggagaagaaataggaagtgaccaatttggaggctgcgttatgtttcatgctcctgtacctggtgctaacatggtaactgggagaatagaatatgtagaggtattccatgctggccaggctttccggttggggcgatatccaatacattggcacctgcttggagacttacagtttaaatcttatgtaagaggctgtgcaattcaccaggcctataacagagctgttactattcataacacacaccatcttctggttgagaggaatattatatatgatattaagggaggagcattttttatagaagatggtattgaacatggcaatatcctccagtataacttggcagtatttgtacagcaaagtaccagtcttctgaatgatgatgtgaccccggctgcattttgggtcaccaacccgaacaataccatacgacacaatgctgttgctggtggcactcactttggcttttggtaccggatgaacaaccaccctgatgggccatcctatgacagaaacatttgtcaaaaaagagttccccttggcgaattttttaacaatactgtccattctcaaggttggtttggaatgtggatctttgaggaatatttccccatgcaaacgggatcttgtacatctacagtgcctgcgcctgcaatatttaactcacttactacttggaattgtcaaaaaggagctgaatgggtcaatggaggtgcccttcagttccataactttgtgatggtgaataactatgaggctggaattgagactaagaggatcctggctccttatgttggagggtggggtgaaaccaatggagcggtgattaaaaatgccaaaatagtcggccatcttgatgaactgggaatggggtctgcattttgcacagcaaaaggcctggttctcccatttagtgaaggcttgactgtctcttctgtgcactttatgaactttgaccgtcccaactgtgtagctttgggagtgacatccatctctggagtttgtaatgacagatgtgggggttggagtgcaaagtttgttgacgtccagtattctcacacaccgaacaaggctggctttcgctgggaacatgaaatggtaatgattgatgttgatggctcacttacagggcacaaaggacataccgtcattccacacagctcattgctagacccttctcattgtactcaggaagctgagtggagcattgggttccctggatcagtctgtgatgcttcagtcagctttcaccgtttagcgttcaaccagccttctccagtatctctgcttgaaaaggatgtggttctttcagactcttttggcacaagcattattccatttcagaagaaacgactgactcatatgtctggatggatggctctgattccaaatgcaaatcacattaactggtattttaaaggtgtggatcacataaccaacatttcatatacatcgacattctatggattcaaggaagaagactatgtaattatatcacataacttcactcaaaatcctgacatgtttaatattattgatatgaggaatggttcctcaaatccattgaattggaatactagcaagaatggggactggcaccttgaagcaaacactagtactctatattacttggtgtcaggaagaaatgaccttcatcagagtcagctcatttctgggaacctggatcctgatgtgaaagacgttgttattaatttccaagcttactgttgtattctccaggattgctttcctgtacatccgccatcaagaaaaccaattcccaagaagcgaccagccacatataatttatggtcaaatgattctttttggcaatcatcacgagaaaataattatactgtacctcacccaggggcaaatgtgattatacctgaaggaacatggattgtagctgacatagatatgccatcaatggaaagactcattatttggggggttctagaactggaagataaatacaatgtaggagctgcagaatcttcttacagagaagttgttttgaatgctacctacatatcactgcagggaggtagattaatcggtggctgggaagataacccttttaaaggagacttaaagattgttcttagaggaaatcatactacacaagactgggctcttccagaaggaccaaatcaaggggcaaaggtcttaggggtgtttggtgagctggatcttcatggaattccacattcaatatataaaactaagctctcagaaactgcatttgcaggttccaaagtcctgtctctgatggatgctgtggattggcaggagggagaagagattgtgataacaaccacaagctacgatttccaccagacagaaacaagaagtatcgttaaaatcctgcatgatcataaaattctcattcttaatgatagcctttcctatactcactttgctgaaaaataccatgtccctggaactggtgagagctacacgttagcagctgatgttgggatactgagtaggaacatcaaaatagttggtgaagattaccccggttggtctgaggactcttttggagcacgcgtactggttggctcattcactgaaaatatgatgacatttaaaggaaatgcaagaataagtaatgtggaattttatcacagtggtcaagaaggcttcagggatagcacagatccaagatatgctgtaacgtttcttaacctaggacagattcaagaacatggctcatcttatattcgaggctgtgcttttcaccatggcttctctccagcaattggtgtatttgggacagatggattggacatagatgacaacatcattcactttacagtgggggaaggcataagaatatgggggaatgccaaccgagtccgagggaatttgattgcactttcggtttggccaggaacctatcagaacagaaaagatttaagttcaactctctggcatgcagcaattgagataaatagagggaccaatacagttttacagaataatgtagtggctggatttggaagagcaggataccgcattgatggtgaaccttgcccaggccagtttaatcctgtggaaaagtggtttgacaatgaagcccatggaggtttatatgggatctatatgaaccaagatggccttcctggatgttctcttatacaaggatttaccatttggacatgctgggattatggaatttattttcagaccacagagagtgtgcacatttataatgtgaccctggttgacaatggaatggccatttttccaatgatttacatgccagctgctatatcacacaaaatttccagtaaaaatgtacaaattaagagctcattaattgttggaagtagccctgggtttaattgctctgatgtcctaactaatgatgatcctaatattgaactcactgctgctcatcggagtcctagatctccatcaggtgggagaagtgggatttgttggcctacctttgcttcagctcataacatggcaccccgaaagccccatgcaggaatcatgagttacaatgccatcagtggccttttggacatctcaggttcaacatttgttggatttaagaatgtttgttcaggggaaactaatgttatattcattactaaccctttaaatgaggatttacagcatccaatccatgtgaagaatataaaactggttgataccactgaacaatcaaaaatatttatacataggcctgatataagtaaggtcaatccatctgattgtgtagacatggtttgtgatgccaagaggaaatcttttcttagagacatagatggctcctttctggggaatgctggttctgtgatacctcaagcagaatatgaatgggacggaaacagccaagtaggaattggagactacagaattcctaaggcgatgctcacattcttgaatggaagtagaattcctgtcactgagaaagcacctcataaaggaattattagagattcaacctgtaagtaccttccagagtggcagagctatcagtgctttgggatggaatatgcaatgatggttattgaaagtctggatcctgacacagaaactcgaagactttccccagtggctataatgggcaacggttatgttgatcttattaatggcccacaggatcatggctggtgtgctggatatacatgccagagaaggctgtccctgtttcacagcattgtggctctgaacaaatcttatgaagtttacttcactggcaccagtcctcagaatcttcgactgatgttgcttaatgttgatcataacaaggctgttctagtaggaattttcttttccacacttcaacgtttggatgtctatgtgaacaacttattggtctgtccaaaaactacaatatggaatgcccagcagaaacactgtgaacttaataaccatctgtacaaagaccaattccttcctaacctggattccactgtccttggtgaaaactactttgatggaacctaccagatgctttatcttttggttaaaggaactatacctgttgaaattcacactgccacagtgatatttgtttctttccaattatctgttgcaacagaagatgacttttatacctctcacaatctggttaaaaatcttgccttgttcctaaagataccaagtgacaaaatccgtatcagcaaaataagagggaagagtctgaggaggaagagatccatgggattcataattgaaatagagattggagaccctcctattcagttcataagcaatggcaccacaggtcagatgcagttatctgaactccaggaaattgctggttctcttggacaagctgtaattttaggaaacatcagtagtatccttggatttaacatttcgtccatgtctattactaatcccctccccagcccaagtgactctgggtggattaaggtgactgcccagccagttgaaaggtctgcatttcctgttcatcacgtggccttcgtgtcctcactcttagtgatcactcagccggtggcagcacagccaggacagccatttcctcagcagccttcggtaaaggcaacagattctgacggtaactgtgtatcagttggaattactgcactaactttgagggccatactcaaggactccaataataaccaagtcaatggccttagtggaaatacaacaattccgtttagcagctgttgggccaactacacagaccttactccccttagaacaggaaaaaattataagattgaatttatactggataatgttgttggggtagaatccagaactttcagcctgctggcagagtctgtctctagcagtggcagcagcagcagcagcaacagcaaagcatcaactgtgggtacatatgcccagataatgactgtagtaattagctgtctggttggaagaatgtggctcttggaaatatttatggctgcagtttcaactttgaatataactttaagaagctactaaagtgctgttccgaagaataggctgaaacaaaaatataagaattattagctactttgttgggcaataggcaaaagtctatagcattttcatgaaaatatactaaaaatatttttatgatatataaaatgtactaattagctttaaacactaaaatcagatttcttcaaaatataaatttgttttgattctttatatttatatgtttttatttcatttcaataaacttccagaaatttgtcatttggaaaaaaaaaaaaa

SEQ ID NO: 31456 - DNA, 1497 bp, Homo sapiens
ggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattccgcaaaaaaaaaaaaaaaaaaaaaaaaaaaaaaaaa

SEQ ID NO: 31457 - DNA, 4115 bp, Homo sapiens
gacaggggctctgggcggccggggagcatgcccgcgcggctacgctgaatggcgcctcctctgcgacccctcgcccggctgcgaccgccggggatgctgctccgcgcgctcctgctcctgctgctgctcagtcctttgccaggagtgtggtgctttagcgaactgtcttttgtaaaagaaccacaggatgtaactgtcacaagaaaggacccagtcgttttagattgccaggctcacggagaagttcctattaaggtcacatggttgaaaaatggagcaaaaatgtctgaaaataaacggatcgaggttctttctaacggctctttatacatcagtgaggtggaaggcaggcgaggagagcagtccgatgaaggattttatcagtgcttggcaatgaacaaatatggagccattcttagtcaaaaagctcatcttgccttatcaactatttctgcatttgaagtccagccaatttccactgaggtccacgaaggtggagttgctcgatttgcatgcaagatttcatcccaccctcctgcagtcataacatgggagttcaatcggacaactctacctatgactatggacaggataactgccctaccaacaggagtattgcagatctatgatgtcagccaaagggattctggaaattatcgttgtattgctgccactgtagcccaccgacgtaaaagtatggaggcctcgctaactgtgattccagctaaggagtcaaaatccttccacacaccaacaattatagcaggtccacagaacataacaacatctcttcatcagactgtagttttggaatgcatggccacaggaaatcccaaaccaatcatttcttggagccgccttgatcacaaatccattgatgtctttaatactcgggtacttggaaatggtaatctcatgatatctgatgtcaggctacaacatgctggagtatatgtttgtcgggccactacccctggcacacgcaactttacagttgctatggcaactttaactgtattagctcctccttcatttgttgaatggccagaaagtttaacaaggcctcgagctggcactgctcgatttgtgtgtcaggcagaaggaatcccctctcccaagatgtcatggttgaaaaatggaaggaagatacattcgaatggtagaattaaaatgtacaacagtaaattggtaattaaccagattattcctgaagatgatgctatttatcagtgcatggctgagaatagccaaggatctattttatctagagccagactgactgtagtgatgtcagaagacagacccagtgctccctataatgtacatgctgaaaccatgtcaagctcagccattcttttagcctgggagaggccactttataattcagacaaagtcattgcctattctgtacactacatgaaagcagaaggtttaaataatgaagagtatcaagtagtcatcggaaatgacacaactcattatattattgatgacttagagcctgccagcaattatactttctacattgtagcatatatgccaatgggagccagccagatgtctgaccatgtgacacagaatactctagaggatgttcccctgagacctcctgaaattagtttgacaagtcgaagtcccactgatattctcatctcctggctgccaatcccagccaaatatcggcggggccaagtggtgctgtatcgcttgtctttccgcctaagtactgagaattcaatccaagttctggagctcccggggaccacgcatgagtaccttttggaaggcctgaaacctgacagtgtctacctggttcggattactgctgccaccagagtggggctgggagagtcatcagtatggacttcacataggacgcccaaagctacaagcgtgaaagcccctaagtctccagagttgcatttggagcctctgaactgtaccaccatttctgtgaggtggcagcaagatgtagaggacacagctgctattcagggctacaagctgtactacaaggaagaagggcagcaggagaatgggcccattttcttggataccaaggacctactctatactctcagtggcttagaccccagaagaaaatatcatgtgagactcctggcttacaacaacatagacgatggctatcaggcagatcagactgtcagcactccaggatgcgtgtctgttcgtgatcgcatggtccctcctccaccaccaccccaccatctctatgcgaaggctaacacctcatcttccatcttcctgcactggaggaggcctgcattcaccgctgcacaaatcattaactacaccatccgctgtaatcctgttggcctgcagaatgcttctttggttctgtaccttcaaacatcagaaactcacatgttggttcaaggtctagaaccaaacaccaaatacgaatttgccgttcgattacatgtggatcagctttccagtccttggagccctgtagtctaccattctactcttccagaagcaccagcaggcccaccagttggagtaaaagtgacattaatagaggatgacactgccctggtttcttggaaaccccctgatggcccagaaacagttgtgacccgctatactatcttatatgcatctaggaaggcctggattgcaggagagtggcaggtcttacaccgtgaaggggcaataaccatggctttgctagaaaacttggtagcaggaaatgtgtacattgtcaagatatctgcatccaatgaggtgggagaaggacccttttcaaattctgtggagctggcagtacttccaaaggaaacctctgaatcaaatcagaggcccaagcgtttagattctgctgatgccaaagtttattcaggatattaccatctggaccaaaaatcaatgactggcattgctgtaggtgttggcatagccttgacctgcatcctcatctgtgttctcatcttgatataccgaagtaaagccaggaaatcatctgcttccaagacggcacagaatggaactcaacagttacctcgtaccagtgcctccttagctagtggaaatgaggtaggaaagaacctggaaggagctgtaggaaatgaagaatctttaatgccaatgatcatgccaaacagcttcattgatgcaaagggaggaactgacctgataattaatagctatggtcctataattaaaaacaactctaagaaaaagtggttttttttccaagactcaaagaagatacaagttgagcagcctcaaagaagatttactccagcggtctgcttttaccagccaggcaccactgtattaatcagtgatgaagactcccctagctccccaggtcagacaaccagcttctcaagaccctttggtgttgcagctgatacagaacattcagcaaatagtgaaggcagccatgagactggggattctgggcggttttctcatgagtccaacgatgagatacatctgtcctcagttataagtaccacaccccccaacctctgattctttcactggcagtgattcaggtggagattccgcattgaggaagtgtgaagaccctgctgtgtcatctgttagtgagcagacttcctccttagttctgcagccgccatctgccatgctatgctttgataaaaatgattttccaatctagacggccatgctcaggtattctcaccattaaatctgttcgaaggacaatgaacagggaaccaaagccttttgtgaaaatcttaatatctttatggggtattttagctttttttgaatgtgttttgttttttatttttaaacttgtgtaatttgaatgtttcattgtcagcaatgtgaaagaacggtcgagatgtttgactggattataaaatatatcactggagcaaagggaagacttttgaaagcccctttgctgactatctacctcagtttgcctcccggcaaactctgaagacaactttgttacctcatttgttgttatagtttatctcagctacataaccaatgatacttcctagtagtattgtgttttcattgctgtacgtgtaatgtgtgtgatcaaaggagtcatataggtagatgagtaagaatgtttatctgaagctctgatttttttaaaaaaa

SEQ ID NO: 31458 - DNA, 7158 bp, Homo sapiens
tcctagtgagtatcgagttggtcttattatcgcgtgaactgggagcctttgtttcctgcgtgtcgcaggaagtgacgtttcgggtacagccgctaccagagtccctttctcgcgaggcggaagaaccccgatcgctgaggagcaagggggcgctaggaaagggaactgggttgcgacggtccggcgagagagagctggggtgctggggtgcggggaagttggggagcagaggccgcttggtgtccgagtagggtaagaccgcaccgacccagtccgttaggaaagaagggaaacgaggcaattgtcgggcggatccccggacggagggctaaggttgtgtggaaggcgctgctccccggatggcgaccgcagatactccggccccggcctccagtggcctctcgccgaaggaagaaggggagcttgaagatggggaaatcagtgacgacgataataacagccagatacggagtcggagcagcagcagcagcagcggcggcgggctgttaccctatccgcggcgaaggcctcctcactcggcccggggcggtggatctggcggaggcggtggctcttcctcgtcatcgtcctcttctcagcagcagctgaggaatttctcacgctcgcggcacgcgtctgagcggggccacctcaggggacccagcagctaccgacccaaagaaccgttccggtctcatccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggattacaagataaagaacaaaatttaacaagaagaattagtacctcagatattctgtctgaaaagaaacttggtgaagatgaagaggaactatctgaattacagcttcgccttttggctcttcagtcagccagtaaaaaatggcaacaaaaagaacagcaggtgatgaaagaaagcaaagaaaagttgactaagacgaaaactgtacagcaaaaagttaaaacaagtacaaaaacacattcggccaaaaaagttagcactacagctaaacaagcattgaggaagcagcaaacaaaggcatggaagaaactacaacaacaaaaagagcaggaaagacagaaagaagaggatcagcggaaacaagctgaagaagaagagagaaggaaaagagaggaagaaatcagaaaaattcgagatctctcaaatcaggaagaacagtacaatcgattcatgaaattggttggtggcaagaggagatcaagaagtaaatcttcagatcctgacctgaggcgatccttagataagcaacctactgatagtggaggaggcatttatcagtatgataactatgaagaagttgctatggatacagatagtgaaaccagttctccagctccttcaccagtgcaaccgccatttttctctgaatgttcattggggtatttttctccagcaccatctctttctttgcctccaccacctcaggtttcttctctgccacctttgagccagccttatgtggaaggcttgtgtgtttctcttgaacctctacctcctctaccaccattaccacctctcccacctgaagatccagaacagcctccaaaaccaccttttgcagatgaggaagaggaggaagaaatgctgcttcgagaagaactacttaaatctctagcaaataaaagagcttttaagccagaggaaacatccagtaatagtgacccaccttcacctccagttctgaacaattcacatcctgtgccaagaagcaatctatcaatagtcagtattaacacagtgtctcagcctaggatacagaatccaaagtttcacagaggaccccgtcttccacgaactgtgatctcgcttccaaagcataaatcagtggttgtaacactaaatgattcagatgatagtgaatctgatggagaggcttccaagtcaacaaatagtgtttttggtggattagagtccatgattaaagaagcaagacgaactgctgagcaagcttcaaaaccgaaagtacctccaaaatctgaaaaagaaaatgatcctctgcgaacaccggaggctttgcctgaagaaaagaagattgaatatagattgttaaaggaagagattgccaaccgtgagaaacagcgtttgattaaatcagatcagctgaagacaagttcatcatccccagcaaactctgatgtggaaattgatggtattggcaggatagcaatggttactaagcaggttacagatgcagaatcaaaactgaaaaaacataggattctcttgatgaaagatgaatctgttttaaagaatttagtgcaacaagaagctaagaagaaagaatctgttagaaatgctgaagcaaagattacaaaacttacagaacagcttcaagcaactgaaaaaattcttaatgttaacagaatgtttttgaagaagcttcaggaacaaattcacagagttcaacagcgtgttacaattaagaaagctttgactctaaaatatggagaagagcttgctcgggcaaaggcagtggccagtaaagaaataggaaaacgtaaactggaacaagatcgctttgggccaaacaaaatgatgagactggacagttctccagtatcaagtccaagaaagcattcagcagaactaattgctatggagaaaagacggttacaaaagctagaatatgaatatgccctgaaaattcaaaaattaaaagaagcccgtgcccttaaagcaaaggaacaacaaaatatctctccagttgtggaagaggaacccgaattttctttacctcaaccctcacttcatgatctgacacaagataaattaaccctggacactgaagaaaatgatgttgatgatgaaattttgtctggttcaagcagagagcgaagaagatcttttttagaatccaattattttactaaacctaaccttaagcacactgatactgctaacaaagaatgcataaacaaacttaataaaaatactgtagaaaaaccagaactttttctagggttaaaaattggtgaattgcaaaaattgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatagccattgctgctgagattgttctaaagggacaaagagaggtccaccgtttatatcagagagccttacagaagttacctctttgtgcatcactgtggaaagatcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaatatttgaactgctttgtattgaaatactactttgtagtattgaaattgtttatatacttttttaatataagttaactttctaaaaa

SEQ ID NO: 31459 - DNA, 2082 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagctcctcttcttcccacctctactgtgattgatccttcaaggttctgtgctcagcccttccgttggttcttggatttgtcctttcccgccatgtcttcatcacatccacaacttccactaacacttgcgagcttcaaacttcttagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaa

SEQ ID NO: 31460 - DNA, 2007 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagagatggggcctgatggaaggtgtttttgtcatgcatggaggcaggtccccaggacttggtgcagttctcgagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaa

SEQ ID NO: 31461 - DNA, 1986 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggagatggggcctgatggaaggtgtttttgtcatgcatggaggcaggtccccaggacttggtgcagttctcatgatagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaa

SEQ ID NO: 31462 - DNA, 1936 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagatgagaaaaagaagactcagagagcaagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaa

SEQ ID NO: 31463 - DNA, 2468 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcatgaaagaaaacacttaacttgcatgtgcacagcttttggtaacaaatatcgctaaaccttactgtgaatttaggcatctctggcatgccactgtttatgcattgaagtggaatttttggtataaagctaaatggtcttagaagcatagaaaatccctatgtgccaaaagtagtgaaacacaaacaaaggaaaatatattaataacagtctagtgtttttgttgagtctgccattcgtagctgaatatgtgattaattatgtgatgaaaacattttttataaatgatcttggtctattggggagcggggatagttaatattccagtacactgaatacatgaggaatttaaccacatacatcattgaagacaagggatagcagtttgtttttattcaaagacattgctgtgttctctttcattgcctctctcgctttctgtcacttttttcctccttacattaaagaaaagtttaattacagttaaaaatgtataatgtatttataatattcatcgataccattattcaaatattgctcaatacagcaaattagctcctaacctaacaaagtttaagtttacttggattgataattaggtttactctttatctgaataagaaccaattccatttgtttgaaatatggagtttgtgactacccaaattgctaattattctttcttttgaatatattttacatttctatgagcctaaggaagattcatgaaactgacctatgagagtcgtgaagtggtttttcagaatgctatgtaaggaccgatttgagcactaactataggtactctgaatatatatttcccttgattattcaccaaaagtgttccccagtctttgactctttaaattccaatactgattccaaaacaaataaatattttgaagactcaatgaatactttccatattttggcctatttatataagaaagttaataacattgacccttcacagctcttctgcctgctcctcaaagtggctctatctaaatatttattactaaaatgtttttcctacagtctacatgaatacaaacctcaatagctaagcttgacgt

SEQ ID NO: 31464 - DNA, 1844 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaa

SEQ ID NO: 31465 - DNA, 1817 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgtttaa

SEQ ID NO: 31466 - DNA, 1963 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaattaatctgcagtttgcagaactctcagatacagagggcaactgcacattgtgggcaagtacaaacctatcgtgtgctgaacagagaagaaatggaggtactcgtgagcagcattaatgtgtacaccagaatctcaacagtaaagacagaataacatgaagaaaataactacaggagtgctgtgttttaaaaaagcaagctcctccagctgagtttgtgactctaatccctgcttattttgagcactttccatgtgttgattgactcggaaaggtgggagattaccagcaagccaggtcatttgggcaaacatgggcatatttttagcaaagctgaacaaactggttggtcactcgaactacccaatttagacttatagtaagaatagcacatggttcagaattgccaagactgctgctttagtcaacagaaattttttcatatgcatgctggtaatgcagtgcatctctggaagaaatgcaagagtattttaacatttggtccagaagaaatatgtaaagggtgtttgtagaatttgatgccctcttcagtgacataaggttatgggtttgtgaatggaaaatctgttatttgttcaggttattaaaacacattctaattcaacatca

SEQ ID NO: 31467 - DNA, 2353 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagataatgaaagaacggagttggacattttattgcaattcctgcttccctgaatttgcatatttcttcccacctgagaaggataattatatattttaatttggattatttcttcatttttatctttttattttaatgattgttttgtcagtaatacccatggagatcaactttattattataatccatgcctctgaatattagattggtttcttggatgggattttgaatatgcatttaagaagttgggaagaatttcacagatgatgattggaggaaaagtgatgaaaagaaagacctgtgttccaggagttttctccaacttcaaacctttacgtgaatcttaaccaaagtggacatctttacatttcatgatagcttgcttttgcaatatgagtttgaaaaatcagtataagcttatgatggtgaaaagtcaacatattgagagtgataattcaattaataggatatgaacttaacgacatataaaagcaaatgagggcaggagggaatcgtgacaaaaaatatttgtgcccaattatgattaatgttttagagatgttgtgtccctgtgggcttagcatggaactaaaagttcctaagtctcaattctagttatgtgtcatttagtaactcaggaatctgcttaattgttatttctaagcttttgatgacaaaggagtgatgcagctaagggcatccttggagtgtcataaaaaacaaatttgaggttgaatgattagctgcgcagttagagtgataaaaaaatccaggtaggccttctgattcaccatgaccaagtcaggatttcttaatatttcttttctggcagcatatacaaaggcaaaattaataaataacagttgttgaataacaaactttattacgtttttataaaataaaagaatctattttgtctgtattaaaataaaaaactttgtggacttctaaaagat

SEQ ID NO: 31468 - DNA, 1816 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagatgagaaaaagaagactcagagagcaattctggaggccggcaagttcaggatcagggtgccagcagattcggtgtctgactggagtgcagtggagtgatttccgctcactgcaaccttcacctcctccactcactgcaatcttcgcctcctgggttcaagtgattctcctgcctcagcctcccaagtagctggaattgcaggcatgcgccacaagcctggctaatttttgcatttttagtagagatgaggtttcaccatgtttgccaggctggtcttgaacacctgacctcaagtaacccacccaccttggcctcccaaagagctgggattacaggcatgagccaacgtgcctggccatgttctgatcgtttaatgatagcaacatttagtattatagagcatgaaaatgtcaaag

SEQ ID NO: 31469 - DNA, 828 bp, Homo sapiens
aaaagtcaccatttaaggggtctgcagtccaattcatcagttgtctttagtttactcagcatcagctactaacatacctgaacgaagatcttgttctaagacattgtatgtgaagatgatacctgcaaaagacatggctaaagttatgattgtcatgttggcaatttgttttcttacaaaatcggatgggaaatctgttaagaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtgaaaatgaaaacagatattgtcagagttctgctctagacagtgtagggcaacaatacatgctgctaattcaaagctctattaagatttccaagtgccaatatttctgatataacaaactacatgtaatccatcactagccatgataactgcaattttaattgattattctgattccacttttattcatttgagttattttaattatcttttctattgtttattctttttaaagtatgttattgcataatttataaaagaataaaattgcacttttaaacctctcttctaccttaaaatgtaaaacaaaaatgtaatgatcataagtctaaataaatgaagtatttctcactcaaaaaaaaaaaaaaa

SEQ ID NO: 31470 - DNA, 1926 bp, Homo sapiens
gtggatgagctgtgagtgcgcgcgcgtgcgcggggccgcgacctgtgccggctcgagcccgctgggcactcggaggcgcgcacgtcgttccccgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaaaaaa

SEQ ID NO: 31471 - DNA, 3572 bp, Homo sapiens
ggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcctgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaaaaaaagaaaaaaaaaaaaaaaaa

SEQ ID NO: 31472 - DNA, 5555 bp, Homo sapiens
agtccaggtttcatctcggtttctctgccttccagcctcatccatgggacaacttccatatcctggaggcccctctgggaaacgctgccttcagcccatgaagtcgctccgctgtgcagtcgtgggcctgtagtaggcagctggagcgtggaccgttgggcttttgtaattaaacagcttttattgtgataaaatatttataatgtataagtgaccattttaaccattttaagtgcacagtttcatggcgttaagaacgttcatattgatgtgcagccatcaccaccctccatctccagaactttctcgtcttcccagatggaaactctgtccccatcccctccttctcctggcacacgccaccactctgctttctttttctatgaatgtggcaactctagggccctcacgtgaggtgagccatgcagtacatgtcctcttgtgtctggctgccttcaccgagcactatgccctcgaggtgcgtccgcgctgcagtgcgtgtcagaactccctttccaagcctgagtgtggacgggccacaccgcgttcatccctccaactgtcactggaccttttggtgccttccagcttttggctgcagtcaatgaggctgctctgggccttggtgaacaaccgtggcttttgccgtctggcagccccatgcgggtggcgctttgctctgccaggcaggagattggcggtgccatgttggtgcttttggtgaagaccagagtgttttcattgcttgccattgaggagtgtttttacttatggaaacgatatactgtctgtgaatatcctgctctaaaaattgataaccaggtcctgcccgatgggtgtttacaaatatttgccatatggaagtcatgaggggactcctgggtcacttacagagggaacagcctataggaggggtacttggcaggtggtggctggagtcccaagttcctgcccttcccaccaggctgcaagggtcaaactgacatctttgggacgagcacaggacatcatcctccagctcagtcccctttgctaaagacacactcaggaggggacagcaccttttgaaacctaactcctgcaaaggggtagatatgtaaacttggggtagccttgtgtcctgggggctaggctgacaaatatctttttaaagatcatctaactgctggggaggctgtctctttgaagatgatttacttcttctaactgggtttcatttttctctcctagcttatgttcctgaggaagaattgaaggcagcagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgttctccgagtcctgctggtccagcttagctctggatttaaagaagtcgggttccaccaccagcaccaacgatgccagccagaaggagagctccgcccccacccccacaccccccacctgccccgtcagcaccactggccccaccacgagcacgcccagcaccagctgcagctccagcaccagccacagcagtaccaccagtaccagcagcagctccgggtacgactggcaccaggctgcactggccaagacgctgcagcagacgtcctcgtatgggctgcttcctgagcccagcctgttcagcaccgtgcagctctaccgccagaacaacaagctctacggctccgtcttcacgggcgccagcaagttccggtgcaaagactgcagtgccgcgtacgacacgctggtggaactgacggtgcacatgaacgagacaggccactaccgtgacgacaacagggacaaggactccgagaagaccaagaggtggtccaagcccaggaagcgctccctgatggagatggaggggaaggaggatgcccagaaggtgctgaagtgcatgtactgtggacactcctttgagtccttgcaggacctcagcgtccacatgatcaaaaccaagcattaccagaaagtgcctctgaaggagccagtgccagccatcaccaaactggtcccctccaccaaaaagcgggcgcttcaggacctggcgcccccctgctcccctgagccagcaggaatggccgcagaggtggccctgagtgagtcagccaaggatcagaaagcagcgaacccgtacgtcacgcccaataaccgctatggctaccagaatggcgccagctacacctggcagtttgaggcccgcaaggcgcagatcctcaagtgcatggagtgtggcagctcccacgacacgctgcagcagctcaccgcccacatgatggtcaccgggcacttcctgaaagtgaccacctcggcttctaagaagggcaagcagttggtgctggaccctgtggtggaagagaagatccagtccatcccactaccgcccaccacccacacgcggctgccggcctccagcatcaaaaagcagcccgactctcccgcggggtccacgacttctgaagaaaagaaagagccagagaaggagaagccgcctgtggctggcgacgcggagaagatcaaggaggagagtgaggacagcttggagaaatttgagcccagcaccctgtacccgtacctgcgtgaggaggacctggacgacagccccaagggagggctggacattctcaagtccctggagaataccgtctccacggccattagcaaagctcagaatggtgcgccctcatggggtggctaccccagcatccatgcagcctaccagctcccgggcaccgtgaagccactgccggcggccgtgcagagcgtgcaggtgcagccgtcctatgctggcggcgtgaagtcgctgtcttccgccgagcacaacgccctcctgcactccccagggagcctcacgcccccaccgcacaagagcaacgtgtctgccatggaggagctggtggagaaggtcacgggcaaggtcaacatcaagaaggaggagagaccccctgagaaggagaagagctccctggccaaggctgcgtcccccatagcaaaagagaataaagatttcccgaaaacggaggaagtcagcggcaaaccacagaagaagggccctgaggccgagactgggaaggccaaaaaggagggaccgctggacgttcacaccccaaatggcacagagcctctcaaagcaaaggtcaccaacggctgtaacaacctggggatcatcatggaccactcaccggagccttccttcatcaacccgctgagcgctttgcagtccatcatgaacacccacctgggcaaggtgtccaagcccgtgagtccctcgctggacccgctggcgatgctgtacaagatcagcaacagcatgctggacaagccggtgtaccccgccacccctgtgaagcaggccgatgccatcgaccgctactattatgaaaacagcgaccagcccattgacttaaccaagtccaagaacaagccgctggtgtccagcgtggctgattcggtggcatcacctctgcgggagagcgcactcatggacatctccgacatggtgaaaaacctcacaggccgcctgacgcccaagtcctccacgccctccacagtttcagagaagtccgatgctgatggcagcagctttgaggaggcgttggacgagctgtcaccggtccacaagaggaagggccggcagtccaactggaacccgcagcaccttctcatcctgcaggcccagttcgcctcgagcttgcgggagaccacagagggcaagtacatcatgtcggacttgggcccgcaggagagggtgcacatctcgaagtttactgggctctccatgaccaccatcagccactggctggccaatgtgaagtaccagttgaggaggacagggggaacgaaattcctaaagaacctggacacagggcatcctgttttcttttgcaacgattgtgcctctcagttcagaactgcttctacatacataagtcatttggagacacacttgggcttcagcctgaaggatctctccaagctgccactcaatcagattcaagaacagcagaatgtttcgaaagtcctcaccaacaaaactctgggcccactgggggccaccgaggaagacttgggctccacattccaatgtaagctctgcaaccggacttttgcgagcaagcacgcagtcaaactgcaccttagtaagacccacggcaagtctcccgaggaccacctgatctatgtgactgagttggagaaacagtagcgtccaggtatgcaagagaccgcggaacattgcactaaacgtcgtcgagctgcactaggcctggcctgagcctctgaaatcagtctttcctttgttgctggcccgcctctctggaccttggttttcttacacatattttgtatatttatatgctctctgtccgatctgtgcatgttatttttctttttccgtgagtcaaagtctgacctttattttcaacatctgttcttggtgttaagctatcttttgtaggaaatagtggggcacactactcagagacattatttagcagtaaagaaagacacaaataacaatgataaaaagacatcctaaaatggtgaagttgccatgacaataaaggtcatagaacctggtagtgtcaaatttaaccctttgaggactgtaattgcatttctgtgcctttcacttgaaaaaaaaaaaagaagaaaaaaaggcttaaaggcatttcattcagatcaaaagctgtgtcagacacaaaacttatttaataattaaaaaatgagcttttatatgcagaactggtttgtgaggaaacatgcatgcagctgtgggaagatagaaagctgtctaggactcacggggttcggaagccacacctctacatgtctaaaacaaaaaacaacaacaacagataccccactcgccactatgcccaaaccctctggatgctgaaaaatgccactttcggcaaaaaaaaaagtatgcaagctattatttaaaaatgtgtaaaaatgctatttcttttttcctgtaaaatattgcagtttatagttatttacaaatgtaagctttggtacaagctgacctttctatagcgtgctgcattggtaaatgaaaaaaaatggggcaaacgttggagtcctttccttgtaaattgccagcatcagcttaaaaactcctgtatgttacatatcgtaccattttaatctcttcaactttctttgtaccttctggctgtatgctttctcttttaactttttatattgtcattttatattaaatttctgtgtatataatgtaaaaccacaatttttgaataaaatttagttcctgcagcttgaaaaaaaaaaaaaaaaaaaaaaaaaaaaaaaaaaaaaaaaaaaaaaaaaa

SEQ ID NO: 31473 - DNA, 3307 bp, Homo sapiens
cctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaagggagcatcacagaaagaagtgaatgcccaaagcagtgatcctatgcctgtgactcagaaggaacaggaaaacaaatccaatgcatttccctctacatcatgtgaaaactcctttccagaagactgtacatttctaacaacaggaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactatggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcaaaaaaaaaa

SEQ ID NO: 31474 - DNA, 1155 bp, Homo sapiens
ggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctga

SEQ ID NO: 31475 - DNA, 3482 bp, Homo sapiens
gggcgggccgggcgctgggagctggctgtcccaggagcagagcagtctccctgtccagatcaccaggatccctgcttgctggagaatgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgtggtttctgtacatcgtcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcct

SEQ ID NO: 31476 - DNA, 4562 bp, Homo sapiens
cccgcactctgcgcctctcctcgcctttctcgcacctgctcctgcgccaggccgcgagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctccctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttggagaaaggactgctctgtggagcagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactggaaaaaaaaaaaaaaaaaaaaaaaaaaaaaaaaaaaaaaaaaa

SEQ ID NO: 31477 - DNA, 4930 bp, Homo sapiens
ctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcagttgttcaagaaagagagcctttggtgtgctaaagactcttgtgcccatcttggagtggctccccaaataccgagtcaaggaatggctgcttagtgacgtcatttcgggagttagtactgggctagtggccacgctgcaagggatggcatatgccctactagctgcagttcctgtcggatatggtctctactctgcttttttccctatcctgacatactttatctttggaacatcaagacatatctcagttggaccttttccagtggtgagtttaatggtgggatctgttgttctgagcatggcccccgacgaacactttctcgtatccagcagcaatggaactgtattaaatactactatgatagacactgcagctagagatacagctagagtcctgattgccagtgccctgactctgctggttggaattatacagttgatatttggtggcttgcagattggattcatagtgaggtacttggcagatcctttggttggtggcttcacaacagctgctgccttccaagtgctggtctcacagctaaagattgtcctcaatgtttcaaccaaaaactacaatggagttctctctattatctatacgctggttgagatttttcaaaatattggtgataccaatcttgctgatttcactgctggattgctcaccattgtcgtctgtatggcagttaaggaattaaatgatcggtttagacacaaaatcccagtccctattcctatagaagtaattgtgacgataattgctactgccatttcatatggagccaacctggaaaaaaattacaatgctggcattgttaaatccatcccaagggggtttttgcctcctgaacttccacctgtgagcttgttctcggagatgctggctgcatcattttccatcgctgtggtggcttatgctattgcagtgtcagtaggaaaagtatatgccaccaagtatgattacaccatcgatgggaaccaggaattcattgcctttgggatcagcaacatcttctcaggattcttctcttgttttgtggccaccactgctctttcccgcacggccgtccaggagagcactggaggaaagacacaggttgctggcatcatctctgctgcgattgtgatgatcgccattcttgccctggggaagcttctggaacccttgcagaagtcggtcttggcagctgttgtaattgccaacctgaaagggatgtttatgcagctgtgtgacattcctcgtctgtggagacagaataagattgatgctgttatctgggtgtttacgtgtatagtgtccatcattctggggctggatctcggtttactagctggccttatatttggactgttgactgtggtcctgagagttcagtttccttcttggaatggccttggaagcatccctagcacagatatctacaaaagtaccaagaattacaaaaacattgaagaacctcaaggagtgaagattcttagattttccagtcctattttctatggcaatgtcgatggttttaaaaaatgtatcaagtccacagttggatttgatgccattagagtatataataagaggctgaaagcgctgaggaaaatacagaaactaataaaaagtggacaattaagagcaacaaagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtgattgtcaaagaattccaaagaattgatgtgaatgtgtattttgcatcacttcaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacgatcactctcattcaggattgtaaagatacccttgaattaatagaaacagagctgacggaagaagaacttgatgtccaggatgaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggcaaaatggctagaattattcagacgatttggcagcgtccagggtaagctggtgttataatacgctgctgatctacatcacagatttgctaataatgttcacgtgggccctggcatatctctgttcagttagagtgagtgctgacccaacagcctctgtggtcaagcgagtcacgaatgattaatcataaagaaaaatcagtttttgactgacctggatatccatgagctgcactgatcaccatgtaaggtcacatttagtaaatgctgaaataaaatgattaatgcatttatcaataaaagcctttgaaaatactttggataataaattggagttttaaaaatgcaaatttgcttagtatctaataatgaagtgttattacatatagccggaattgaggatctctttgatcctggaaatggtttacctaaaagctacagaaccaggccaatatattttgaaatattgatgcagacaaatgaaataataaagagattttcatggtttataaaaatcttttttgatatgataataatcatgatcacaactgagatcaaaaaaatatatgacagattattttgtttaaaaatgcagttttaattatcttagtctatagaaatgatcattgcatggaggcatgtataggtatgatctgtgtaaaatctgacataaaaacagtgctattctgagtgaaaatttttttgatgtgcttacataaccatggtgattaaaatgagtttatattttttctcaaaaattttagcagtgtgtaaagtaagtaatctttaactgaactctgaccacttaaaaaaaaatctaaaaattgaactacctatagtagtctgtgtttaaagtgaatttttaaagacaaagcattctaaatgaactcaatataaaaacattcatttggaatgtacatactgaaaaatacaggtttttttgaccaaaagtttttatatcttttctttttatttatttttttcctaagtgccaacaattttctagatattatatacaacacaggctttgatcttggggacttttcccatatatttcacactggagtgaatgaagttgtacttcatttctagagaaaagttatacccaggtccccaattgagaatgtcttgcttgattgaaaacgacatcatcccttggtatactccagggattggtttcaggacccctgcatttaccaaaatttgtgcacactcaagtcctgcagtcacccctgcctaaagatagaatggcttctctgtttttcttctgaaatacaaccagaaacaatgtgtctatttctgaaagaataggattaatgatcatacaaatgggttaatcctgaattctggttgtaaatctggttacagcataactaggattataatgctgcctcattttcacagcactacttgcttatattgacaacaaatcatctcgctaaagagtgaatgtaggccaggcgcggtggctcatgcctgtaatcccagcactttgggaggccgaggcgggtggatcacgaggtcaggagatcgagaccatcctggctaacatggtaaaaccccgtctctactaaaaatagaaaaaaagaaattagcctagcgtggtggctggcgggcgcctgtagtcccagctatttgggaggctaaggcaggagaatggcgtgaacccgggaggcggagcttgcagtgagccgaggtcgtgccactgcactccagcctgggcgacagagcaagactccgtctcaaaaaaaaaaaaaaaaaaaaaaaaagagtgaatgtaatagtcttgcagaaaatgaatgaatacctttgttcaataaaggaaatatgcactgctcacttttttgaaggaaatgccaaagttacgttttacaacaaggctagagtttgtaaattctgggttcatttgtgatgacataagtcagcaaactgcgggaatactgtctcttctatgtattttgtgaatagtaagcataattttagttttgtattatcaatgaaaatttcacttgaaattaaagctgccttttgttatatttttaacctataggataagattccagtattgtatatgagttttaacaaattaaaaaatcaaatcatgtacatttgaaaatatttgcacacatttaaaaataaatgtaaagttgtcttttaaactactcggatgtgtcctttctgaacaaaa

SEQ ID NO: 31478 - DNA, 2490 bp, Homo sapiens
gctgtcagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgaggacagggccagccgcgggactgacaccctgggatggaacctcaggatgggccaaacccagacaacgggcccatggccttgggctctgattggctggattgccttgtatgcaaatgagttcaggactacaataccctaccctatggggaggccctgcctccgggaggtcattttttaaatccagccccttgcttcaaccgtccccagtatt

SEQ ID NO: 31479 - DNA, 1510 bp, Homo sapiens
ggcagtcggtgggcgcggcggctgctggaggctagcgcgacccgactcttaagttttcttttcctctccagaggggccgattagggagagagaccaggaatgagtggaatgctatcttaagccaaaaaaaactattataatttttatttagtactacttaaatgaagagagataaaaaaagaaacaaaattccaattgataattatcccattcagacattagtgaatatgtcactcaatccaagtcgaccttcctcatcagagttggtggaacttcatgttttttatgtccctgaaggatcatggaactataagctaaataccatttcaacagaagttgttaacaaattcatttcagctggatttctaagagtatctcctcaacttactttacgagccctgagggagcgtcttggtgagttcctgggtgaagatgctattgcagaaaaatttttatttctgaaatgcattggaaataatttagctgtggtgaaggaaaagcaagaatcagaactgaaactcaaatcatttgctcctccatatgctcctcaaccagaattatatttgcttcctgtaatggaccatttaggaaatgtttattcaccatcaacagttattttagatgagcggcagactaataatggtgttaatgaggctgatggaacaatccacagaccaattagtgtaactttgttcaaggaggaacttggaagagatcccagtttgttagaaaacactttgaaagagcttcctaacaagaatcaggaagaagctgggggaaaagccactgcagaaaaaagccaaattgcaaaaaatcaaattggaaattctgagttgccaggatcattggaagattcaaataatgattgctttggcactaaaaaaagtgtctttgggaaaatgaagatgatacagctatcagtagaagacaggacaatcagacagttgaaaaagagtacatcaccctaccagatcacccttcacttccttgtcaacctgttctttcttcaggaataactgatatatctttattacaaactgaaagagagaagattatcaaacaaatgaaacaagtaaaggaagaaagaaggtatctggaaagaaatagagaagaaccagtaaaaacggttgaaaagctatttgaacaaagcaaattaaaacgatatcatgcctacaatggttggaagaaaaaatacttggaaacaaagaaagtcacagcatcaatggaggaggttttaacaaaacttcgagaagatttggaactctactataaaaaactgctcatgcaacttgaagccagggagatcaagatgagaccaaagaatctggcaaacatcacagactccaagaattacctaataatccagatcactgaggtacagcatgcaattgaccagcttaagagaaaactagatactgacaaaatgaaactcatagtagaagttaaggatgagaaaacaagcagtttcagatttacgaacattgaaaactgaactggccagaaaaaaaaa

SEQ ID NO: 31480 - DNA, 2780 bp, Homo sapiens
gcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctgatt

SEQ ID NO: 31481 - DNA, 998 bp, Homo sapiens
gcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgaatgaagatgaaggatcattgatttccttgtgtatggataatccgggaacaggccaactaaatatttgatgaatgtatgatttcaaatacagtgaattccctgggagtcatcaaagaagaccggcattttatggttgtttttattaagtgtatattctttgctcctgaaaatgttattaaataattgtttaggccgggcatggtggctcatgcctgtaatcccagcactttcaaaggctgaggcaggcagatcacctgaggtcaggagttcaaaaccagcctggccaacatgctgaaacctcgtctctactaaaaatacaaaaattagctgggcgtggtggtggatacctgtaatcccagctacgtgggaggctgaggtgggagaattgcttcaacctgggaggcagaggttgcagtgagccgagatcatgccactgcactccagcctgggcaacagagcaagactgtctcaaaaataaataaataaataaaattgtttaaataaaaaaaaaaaaaaaaaaaaaaaaaaaaaa

SEQ ID NO: 31482 - DNA, 8453 bp, Homo sapiens
gcagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 31483 - DNA, 3969 bp, Homo sapiens
actgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacataacattgaaaaatgaggcataaaaatgcaataaactgttacagtcaagaccattaatggtcttctccaaaatattttgagatataaaagtagggaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaatttttacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttaaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacagttgtatgtctactcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaaaaaaaaaaaaga

SEQ ID NO: 31484 - DNA, 2130 bp, Homo sapiens
gggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccagggagagagggtggtcgtctgtgcattccaggttactgcacttgtctgatgtgacgtagcaacacccaggtcttcttaaaacaaagtcatcagctttgccaggttacatactttatttaaaagtatagtgaggtcgaagttcattccagtgtttcattttaataatgtgggcattattaaatttttgtggaagctaatagtaaaaaataaaagctgttttcaccacctccctccccaccccccaaaaaaggcgtacagccaactcttagttatttagggtaagagaaaaaaaaaaaaaaa

SEQ ID NO: 31485 - DNA, 3135 bp, Homo sapiens
aaggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacag

SEQ ID NO: 31486 - DNA, 2969 bp, Homo sapiens
aaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacag

SEQ ID NO: 31487 - DNA, 3005 bp, Homo sapiens
aaggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacag

SEQ ID NO: 31488 - DNA, 3003 bp, Homo sapiens
aaggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacag

SEQ ID NO: 31489 - DNA, 2616 bp, Homo sapiens
aaggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaaatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacag

SEQ ID NO: 31490 - DNA, 4410 bp, Homo sapiens
cctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgcaggcgatgtttcaatgtttcatggggcaagagtttatctctggagagtgattagtattaacctaatcattgcccccaagaaggaagttaggctaccagcatatttgaatgccaggtgaaatcaaaataatctacactatctagaagactttcttgatgccaagtccagagatgtcattgtgtaggatgttcagtaaatattaactgagctatgtcaatatagagcttctcagttttgtataacatttcatactaaagattcagcaaatggaaaatgctattaatttggttggtgaccacaagataaaatcagtcccacgttggctcagttcaactagatgttccctgatacaaagagaacttgatttccttaaaactgaaaagccaaacacagctagctgtcatacaagaaacagctattatgagacatgaaggagggtaagaattagctttaagttttgttttgctttgttttgttttttaactcaacctattaatcatctcttcacaagaatccacctgatgtgaccaagctattatgtgttgcctggaaaaactggcaagatttcagcttatgtggcctagcaaactaagaattgctcttcttggccagcctcatagcataaaagatgtgaactctaggaagtctttctgagtagcaataagtgggaattatgggcagagcacactcaatcccctgttgattaataaaacaggctggacactaattaactatgggacttaaatctgtagaaatgaaggagtccaatagcttcttccaattttaaaactctagtacatccctttccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgttatatcaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtgaaaaaaaaaa

SEQ ID NO: 31491 - DNA, 1183 bp, Homo sapiens
cctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgctacctcttggaagaaagtccttgtcctttgagactcagaaggccccacgctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaataaaaacattttttaaacagcatgaaaa

SEQ ID NO: 31492 - DNA, 1297 bp, Homo sapiens
gtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaa

SEQ ID NO: 31493 - DNA, 2573 bp, Homo sapiens
ggcggggcccggtccagaggcggggacagcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggtgagaggggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtgcaaaaaaaaaaaaaaaaaa

SEQ ID NO: 31494 - DNA, 2605 bp, Homo sapiens
ggcggggcccggtccagaggcggggacagcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggtgagaggggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtgcaaaaaaaaaaaaaaaaaa

SEQ ID NO: 31495 - DNA, 2596 bp, Homo sapiens
ggcggggcccggtccagaggcggggacagcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtgcaaaaaaaaaaaaaaaaaa

SEQ ID NO: 31496 - DNA, 899 bp, Homo sapiens
gtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaaaaaaaaaaaaaaaaaaaaaaaaaaaaaaaaaaaaaaaaaaaaaaaaaaaaaaaaa

SEQ ID NO: 31497 - DNA, 3279 bp, Homo sapiens
ctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatggaaggccagatctggttcttgccacgttccctacagcttacaggcttccaagcctacaaactacgggtgacacacctgtaccaactgaagcagcacaatattctggcatctgttggagaagatgaagagggcatcaaccccttggttaagatctggaacctggagaagagagatggtggcaatccactctgcactcgaatcttccctgctattccaggaacagagccaactgttgtatcttgtttgactgtccatgaaaatctcaactttatggccattggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtcaaagagaagcttcacgcagaggccatttccctgctgaagagtggtcgcttctgcgacgtctttgacaaggccctggtcctgtgccagatgcacgacttccaggatggtgtcctttacctttatgagcaggggaagctgttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggagcttaaaaaaaaaaaaaaaaaaaaaaaaaaaaaaaaaaaaaaaaaaaaaaaaaaaaaaaaaa

SEQ ID NO: 31498 - DNA, 2990 bp, Homo sapiens
tccggggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacacttaaaaaaaaaaaaaaaaaaaaaaaaaaaaaaaaaaaaaaaa

SEQ ID NO: 31499 - DNA, 1876 bp, Homo sapiens
ccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcccttaaccactggctaggctgaactgcctttgttcttcactgtccccatcacctctttcaaacctcagcctctccttcctcatcgttacatctctaggctgcacctggtctctaaacattcacacaacccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaactgggagcttgaaaatttgtctttggtaacctgatactggacagctgaactgaatggctgcaaaataaatacctcacatgaaaaaaaaaaaaaaaaaaaaaaaaaaaaaaaaaaaaaaaaaaaaaaaaaaaaaaaaaaaaaaaaaaaaaaaaa

SEQ ID NO: 31500 - DNA, 3265 bp, Homo sapiens
gcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgccgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacacttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaaaaaaaaaaaaaaa

SEQ ID NO: 31501 - DNA, 2794 bp, Homo sapiens
gagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactagacagggtcttgccatgttctggaactcataggctcaagtaatcttcctgcctcaacctcccaaagtgctggaattacagttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctaaaaaaaaaaaaaaaaaaaaaaaaaaaaaaaaaaaaaaaaaaaaaaaaaaaaaaaaaaaaaaaaa

SEQ ID NO: 31502 - DNA, 2617 bp, Homo sapiens
cctcgatcccctcgccgcggtcccatggaggaggaggcgagccgcagcgccgcggcgacgaacccagggagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttc

SEQ ID NO: 31503 - DNA, 2583 bp, Homo sapiens
gagagaagaggaggtggagaaggcttgggctcgcgccgctgaagaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcaaaaaaaaaaaaaaaaaaaaaaaaaaaaaaaaaaaaaaaaaaaaaaaaaaaaaaaaaaaaaaaa

SEQ ID NO: 31504 - DNA, 2529 bp, Homo sapiens
gagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgtttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcaaaaaaaaaaaaaaaaaaaaaaaa

SEQ ID NO: 31505 - DNA, 2714 bp, Homo sapiens
gaggaggaggcgagccgcagcgccgcggcgacgaacccagggagaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacgccagcttctgttactgatgtaaggatgcagagtcctgtcaggagttaggtgtcaagtgaagtctccttgttatggggcagtgcagctgtaggccaagctgtatctgtttgggaagggagaaaaaacagtagctggcatccatatccacttctccgggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcaaaaaaaaaaaaaaaaaaaaaaaaaaaaaaaaaaaaaaa

SEQ ID NO: 31506 - DNA, 2262 bp, Homo sapiens
gcgctcccggccgctctcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaaaaaaaaaacagaaggaaaaggaaaaaaaaaaaaa

SEQ ID NO: 31507 - DNA, 2417 bp, Homo sapiens
gcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaaaaaaaaaacagaaggaaaaggaaaaaaaaaaaaa

SEQ ID NO: 31508 - DNA, 2467 bp, Homo sapiens
tcttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacgctctgctttcaacactcttggccctttctcaagagaacatgaaaatgaaaaaatttcagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaaaaaaaaaaaaaa

SEQ ID NO: 31509 - DNA, 3489 bp, Homo sapiens
tcttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacggtggggccgggcggagcgggcctcgggtctgcggagggtggacgcgcgctctccctgtctttggagggagggtttcctgtggtcgggaggcgaggcagccagggcaggattgggctcctgacctgcaggccacgggcgagctctctctagggccctgatttgcccgaagaaggcgcttggtgaaggtgaaaggtttacgcatccaagtagctagagcctctttccagaacttctgctgatgcacttagtcttgcagccattgattattatagctcagcaaagttcagttcaactttcggaagaaggatgtgagctggaatgggcagggtcaagatttgacaggaaaagacacttcactggaggtatctgcgagagtcctgggttggagggaaggagtactggttataaataaggaaatgatgtcttcatcacttcctaaacacatacatgtcattccctaccatctccaccctctgtttattcagagctgcaccaaccatgttcatcacctcacctgggatttactgagtttaccccttacagagctacacgataggggtaaaggaaagactaaaaaccaatttatcttatattaaaattacgacttagtaaatatttttttcagtaatgcagtttgctagtgacagagccaataactgaattctggtcctttgagtaccaggtcagggcttttgtcatctaccacatttacgttacctaccacaagaagtttcttagtaaaaggtcctcttgtgaaactgcagctaagggaaaccaaactgtcaaaaagacaaacaccttaaagcactttcattcattctctctggattctgtcatctcaagtggctaaacacattagtaggaaaacagctctgctttcaacactcttggccctttctcaagagaacatgaaaatgaaaaaatttcagagatggggttttgccgtgttgcccagactgatcttgagcttctgagctccagcgatcagcctacctcaacctctcagagtgctgggattataggtgtgcgccaccacacctggccatgtgtgttttcttacatctcctttcttacataaaagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaaaaaaaaaaaaaa

SEQ ID NO: 31510 - DNA, 1855 bp, Homo sapiens
aggcagctttaacctgggtgtgggtgaggatgacactgtgatgctcctagaggtggttcatgaggaatggacgaataagtggttggaactgatatgagaacacatagctgaagaagagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggatgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctgcaaagtcaagttaaaatagtaaaaaatacagatggaagggaatgtgtcagaagcgtgaacacagggaggagctgtgtattgggaagcaatgcagaaaacaagcctattaaaaatcaacttggattaacccttgagtcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccctgcaagccttactaaccatcaagtaatccataccgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcaggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaag

SEQ ID NO: 31511 - protein, 5058 aa, Homo sapiens
MGHAGCQFKALLWKNWLCRLRNPVLFLAEFFWPCILFVILTVLRFQEPPRYRDICYLQPRDLPSCGVIPFVQSLLCNTGSRCRNFSYEGSMEHHFRLSRFQTAADPKKVNNLAFLKEIQDLAEEIHGMMDKAKNLKRLWVERSNTPDSSYGSSFFTMDLNKTEEVILKLESLHQQPHIWDFLLLLPRLHTSHDHVEDGMDVAVNLLQTILNSLISLEDLDWLPLNQTFSQVSELVLNVTISTLTFLQQHGVAVTEPVYHLSMQNIVWDPQKVQYDLKSQFGFDDLHTEQILNSSAELKEIPTDTSLEKMVCSVLSSTSEDEAEKWGHVGGCHPKWSEAKNYLVHAVSWLRVYQQVFVQWQQGSLLQKTLTGMGHSLEALRNQFEEESKPWKVVEALHTALLLLNDSLSADGPKDNHTFPKILQHLWKLQSLLQNLPQWPALKRFLQLDGALRNAIAQNLHFVQEVLICLETSANDFKWFELNQLKLEKDVFFWELKQMLAKNAVCPNGRFSEKEVFLPPGNSSIWGGLQGLLCYCNSSETSVLNKLLGSVEDADRILQEVITWHKNMSVLIPEEYLDWQELEMQLSEASLSCTRLFLLLGADPSPENDVFSSDCKHQLVSTVIFHTLEKTQFFLEQAYYWKAFKKFIRKTCEVAQYVNMQESFQNRLLAFPEESPCFEENMDWKMISDNYFQFLNNLLKSPTASISRALNFTKHLLMMEKKLHTLEDEQMNFLLSFVEFFEKLLLPNLFDSSIVPSFHSLPSLTEDILNISSLWTNHLKSLKRDPSATDAQKLLEFGNEVIWKMQTLGSHWIRKEPKNLLRFIELILFEINPKLLELWAYGISKGKRAKLENFFTLLNFSVPENEILSTSFNFSQLFHSDWPKSPAMNIDFVRLSEAIITSLHEFGFLEQEQISEALNTVYAIRNASDLFSALSEPQKQEVDKILTHIHLNVFQDKDSALLLQIYSSFYRYIYELLNIQSRGSSLTFLTQISKHILDIIKQFNFQNISKAFAFLFKTAEVLGGISNVSYCQQLLSIFNFLELQAQSFMSTEGQELEVIHTTLTGLKQLLIIDEDFRISLFQYMSQFFNSSVEDLLDNKCLISDNKHISSVNYSTSEESSFVFPLAQIFSNLSANVSVFNKFMSIHCTVSWLQMWTEIWETISQLFKFDMNVFTSLHHGFTQLLDELEDDVKVSKSCQGILPTHNVARLILNLFKNVTQANDFHNWEDFLDLRDFLVALGNALVSVKKLNLEQVEKSLFTMEAALHQLKTFPFNESTSREFLNSLLEVFIEFSSTSEYIVRNLDSINDFLSNNLTNYGEKFENIITELREAIVFLRNVSHDRDLFSCADIFQNVTECILEDGFLYVNTSQRMLRILDTLNSTFSSENTISSLKGCIVWLDVINHLYLLSNSSFSQGHLQNILGNFRDIENKMNSILKIVTWVLNIKKPLCSSNGSHINCVNIYLKDVTDFLNIVLTTVFEKEKKPKFEILLALLNDSTKQVRMSINNLTTDFDFASQSNWRYFTELILRPIEMSDEIPNQFQNIWLHLITLGKEFQKLVKGIYFNILENNSSSKTENLLNIFATSPKEKDVNSVGNSIYHLASYLAFSLSHDLQNSPKIIISPEIMKATGLGIQLIRDVFNSLMPVVHHTSPQNAGYMQALKKVTSVMRTLKKADIDLLVDQLEQVSVNLMDFFKNISSVGTGNLVVNLLVGLMEKFADSSHSWNVNHLLQLSRLFPKDVVDAVIDVYYVLPHAVRLLQGVPGKNITEGLKDVYSFTLLHGITISNITKEDFAIVIKILLDTIELVSDKPDIISEALACFPVVWCWNHTNSGFRQNSKIDPCNVHGLMSSSFYGKVASILDHFHLSPQGEDSPCSNESSRMEITRKVVCIIHELVDWNSILLELSEVFHVNISLVKTVQKFWHKILPFVPPSINQTRDSISELCPSGSIKQVALQIIEKLKNVNFTKVTSGENILDKLSSLNKILNINEDTETSVQNIISSNLERTVQLISEDWSLEKSTHNLLSLFMMLQNANVTGSSLEALSSFIEKSETPYNFEELWPKFQQIMKDLTQDFRIRHLLSEMNKGIKSINSMALQKITLQFAHFLEILDSPSLKTLEIIEDFLLVTKNWLQEYANEDYSRMIETLFIPVTNESSTEDIALLAKAIATFWGSLKNISRAGNFDVAFLTHLLNQEQLTNFSVVQLLFENILINLINNLAGNSQEAAWNLNDTDLQIMNFINLILNHMQSETSRKTVLSLRSIVDFTEQFLKTFFSLFLKEDSENKISLLLKYFHKDVIAEMSFVPKDKILEILKLDQFLTLMIQDRLMNIFSSLKETIYHLMKSSFILDNGEFYFDTHQGLKFMQDLFNALLRETSMKNKTENNIDFFTVVSQLFFHVNKSEDLFKLNQDLGSALHLVRECSTEMARLLDTILHSPNKDFYALYPTLQEVILANLTDLLFFINNSFPLRNRATLEITKRLVGAISRASEESHVLKPLLEMSGTLVMLLNDSADLRDLATSMDSIVKLLKLVKKVSGKMSTVFKTHFISNTKDSVKFFDTLYSIMQQSVQNLVKEIATLKKIDHFTFEKINDLLVPFLDLAFEMIGVEPYISSNSDIFSMSPSILSYMNQSKDFSDILEEIAEFLTSVKMNLEDMRSLAVAFNNETQTFSMDSVNLREEILGCLVPINNITNQMDFLYPNPISTHSGPQDIKWEIIHEVIPFLDKILSQNSTEIGSFLKMVICLTLEALWKNLKKDNWNVSNVLMTFTQHPNNLLKTIETVLEASSGIKSDYEGDLNKSLYFDTPLSQNITHHQLEKAIHNVLSRIALWRKGLLFNNSEWITSTRTLFQPLFEIFIKATTGKNVTSEKEERTKKEMIDFPYSFKPFFCLEKYLGGLFVLTKYWQQIPLTDQSVVEICEVFQQTVKPSEAMEMLQKVKMMVVRVLTIVAENPSWTKDILCATLSCKQNGIRHLILSAIQGVTLAQDHFQEIEKIWSSPNQLNCESLSKNLSSTLESFKSSLENATGQDCTSQPRLETVQQHLYMLAKSLEETWSSGNPIMTFLSNFTVTEDVKIKDLMKNITKLTEELRSSIQISNETIHSILEANISHSKVLFSALTVALSGKCDQEILHLLLTFPKGEKSWIAAEELCSLPGSKVYSLIVLLSRNLDVRAFIYKTLMPSEANGLLNSLLDIVSSLSALLAKAQHVFEYLPEFLHTFKITALLETLDFQQVSQNVQARSSAFGSFQFVMKMVCKDQASFLSDSNMFINLPRVKELLEDDKEKFNIPEDSTPFCLKLYQEILQLPNGALVWTFLKPILHGKILYTPNTPEINKVIQKANYTFYIVDKLKTLSETLLEMSSLFQRSGSGQMFNQLQEALRNKFVRNFVENQLHIDVDKLTEKLQTYGGLLDEMFNHAGAGRFRFLGSILVNLSSCVALNRFQALQSVDILETKAHELLQQNSFLASIIFSNSLFDKNFRSESVKLPPHVSYTIRTNVLYSVRTDVVKNPSWKFHPQNLPADGFKYNYVFAPLQDMIERAIILVQTGQEALEPAAQTQAAPYPCHTSDLFLNNVGFFFPLIMMLTWMVSVASMVRKLVYEQEIQIEEYMRMMGVHPVIHFLAWFLENMAVLTISSATLAIVLKTSGIFAHSNTFIVFLFLLDFGMSVVMLSYLLSAFFSQANTAALCTSLVYMISFLPYIVLLVLHNQLSFVNQTFLCLLSTTAFGQGVFFITFLEGQETGIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQTLQDVDLTQHQHKQTRALSGGLKRKLSLGIAFMGMSRTVVLDEPTSGVDPCSRHSLWDILLKYREGRTIIFTTHHLDEAEALSDRVAVLQHGRLRCCGPPFCLKEAYGQGLRLTLTRQPSVLEAHDLKDMACVTSLIKIYIPQAFLKDSSGSELTYTIPKDTDKACLKGLFQALDENLHQLHLTGYGISDTTLEEVFLMLLQDSNKKSHIALGTESELQNHRPTGHLSGYCGSLARPATVQGVQLLRAQVAAILARRLRRTLRAGKSTLADLLLPVLFVALAMGLFMVRPLATEYPPLRLTPGHYQRAETYFFSSGGDNLDLTRVLLRKFRDQDLPCADLNPRQKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNKDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 31512 - protein, 901 aa, Homo sapiens
MMMVMQPEGLGAGEGRFAGGGGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDQLQLEFARRAAPFNNWLDGAVEDLQDVWLVHSVEETQSLLTAHDQFKATLPEADRERGAIMGIQGEIQKICQTYGLRPCSTNPYITLSPQDINTKWDMVRKLVPSRDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKRNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 31513 - protein, 148 aa, Homo sapiens
MARIPTAALGCISLLCLQLPGSLSRSLGGDPRPVKPREPPARSPSSSLQPRHPAPRPVVWKLHRALQAQRGAGLAPVMGQPLRDGGRQHSGPRRHSGPRRTQAQLLRVGCVLGTCQVQNLSHRLWQLMGPAGRQDSAPVDPSSPHSYG

SEQ ID NO: 31514 - protein, 480 aa, Homo sapiens
MNSDTHRNFDPTATLRNQGDFTWNSMSGRSVRLRSVPIQSLSELERARLQEVPFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSTSSVLPAAVQACPQYPASMFTP

SEQ ID NO: 31515 - protein, 765 aa, Homo sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVPFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 31516 - protein, 562 aa, Homo sapiens
MSGRSVRLRSVPIQSLSELERARLQEVPFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 31517 - protein, 771 aa, Homo sapiens
MSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 31518 - protein, 974 aa, Homo sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVPFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 31519 - protein, 353 aa, Homo sapiens
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGLILLIYFFFYASLAAVITLCMYTLFLTISPYIPTFTERVKPPGVMIRPFAHSLNFNFNVSEPDTWQHYVISLNGFLQGYNDSLQEEMNVDCPPGQYFIQDGNEDEDKKACQFKRSFLKNCSGLEDPTFGYSTGQPCILLKMNRIVGFRPELGDPVKVSCKVQRGDENDIRSISYYPESASFDLRYYPYYGKLTHVNYTSPLVAMHFTDVVKNQAVPVQCQLKGKGVINDVINDRFVGRVIFTLNIET

SEQ ID NO: 31520 - protein, 398 aa, Homo sapiens
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 31521 - protein, 1282 aa, Homo sapiens
MEAKDQKKHRKKNSGPKAAKKKKRLLQDLQLGDEEDARKRNPKAFAVQSAVRMARSFHRTQDLKTKKHHIPVVDRTPLEPPPIVVVVMGPPKVGKSTLIQCLIRNFTRQKLTEIRGPVTIVSGKKRRLTIIECGCDINMMIDLAKVADLVLMLIDASFGFEMETFEFLNICQVHGFPKIMGVLTHLDSFKHNKQLKKTKKRLKHRFWTEVYPGAKLFYLSGMVHGEYQNQEIHNLGRFITVMKFRPLTWQTSHPYILADRMEDLTNPEDIRTNIKCDRKVSLYGYLRGAHLKNKSQIHMPGVGDFAVSDISFLPDPCALPEQQKKRCLNEKEKLVYAPLSGVGGVLYDKDAVYVDLGGSHVFQDEVGPTHELVQSLISTHSTIDAKMASSRVTLFSDSKPLGSEDIDNQGLMMPKEEKQMDLNTGRMRRKAIFGDEDESGDSDDEEDDEMSEDDGLENGSSDEEAEEEENAEMTDQYMAVKGIKRRKLELEEDSEMDLPAFADSDDDLERSSAEEGEAEEADESSEEEDCTAGEKGISGSKAAGEGSKAGLSPANCQSDRVNLEKSLLMKKAALPTFDSGHCTAEEVFASEDESEESSSLSAEEEDSENEEAIRKKLSKPSQVSSGQKLGPQNFIDETSDIENLLKEEEDYKEENNDSKETSGALKWKEDLSRKAAEAFLRQQQAAPNLRKLIYGTVTEDNEEEDDDTLEELGGLFRVNQPDRECKHKADSLDCSRFLVEAPHDWDLEEVMNSIRDCFVTGKWEDDKDAAKVLAEDEELYGDFEDLETGDVHKGKSGPNTQNEDIEKEVKEEIDPDEEESAKKKHLDKKRKLKEMFDAEYDEGESTYFDDLKGEMQKQAQLNRAEFEDQDDEARVQYEGFRPGMYVRIEIENVPCEFVQNFDPHYPIILGGLGNSEGNVGYVQMRLKKHRWYKKILKSRDPIIFSVGWRRFQTIPLYYIEDHNGRQRLLKYTPQHMHCGAAFWGPITPQGTGFLAIQSVSGIMPDFRIAATGVVLDLDKSIKIVKKLKLTGFPYKIFKNTSFIKGMFNSALEVAKFEGAVIRTVSGIRGQIKKALRAPEGAFRASFEDKLLMSDIVFMRTWYPVSIPAFYNPVTSLLKPVGEKDTWSGMRTTGQLRLAHGIRLKANKDSLYKPILRQKKHFNSLHIPKALQKALPFKNKPKTQAKAGKVPKDRRRPAVIREPHERKILALLDALSTVHSQKMKKAKEQRHLHNKEHFRAKQKEEEEKLKRQKDLRKKLFRIQGQKERRNQKSSLKGAEGQLQ

SEQ ID NO: 31522 - protein, 1476 aa, Homo sapiens
MEGGKGPRLRDFLSGSLATWALGLAGLVGEAEDSEGEEEEEEEEPPLWLEKRFLRLSDGALLLRVLGIIAPSSRGGPRMLRGLDGPAAWRVWNLNHLWGRLRDFYQEELQLLILSPPPDLQTLGFDPLSEEAVEQLEGVLRLLLGASVQCEHRELFIRHIQGLSLEVQSELAAAIQEVTQPGAGVVLALSGPDPGELAPAELEMLSRSLMGTLSKLARERDLGAQRLAELLLEREPLCLRPEAPSRAPAEGPSHHLALQLANAKAQLRRLRQELEEKAELLLDSQAEVQGLEAEIRRLRQEAQALSGQAKRAELYREEAEALRERAGRLPRLQEELRRCRERLQAAEAYKSQLEEERVLSGVLEASKALLEEQLEAARERCARLHETQRENLLLRTRLGEAHAELDSLRHQVDQLAEENVELELELQRSLEPPPGSPGEAPLAGAAPSLQDEVREAEAGRLRTLERENRELRGLLQVLQGQPGGQHPLLEAPREDPVLPVLEEAPQTPVAFDHSPQGLVQKARDGGPQALDLAPPALDSVLEASAECPQAPDSDPQEAESPLQAAAMDPQASDWSPQESGSPVETQESPEKAGRRSSLQSPASVAPPQGPGTKIQAPQLLGGETEGREAPQGELVPEAWGLRQEGPEHKPGPSEPSSVQLEEQEGPNQGLDLATGQAEAREHDQRLEGTVRDPAWQKPQQKSEGALEVQVWEGPIPGESLASGVAEQEALREEVAQLRRKAEALGDELEAQARKLEAQNTEAARLSKELAQARRAEAEAHREAEAQAWEQARLREAVEAAGQELESASQEREALVEALAAAGRERRQWEREGSRLRAQSEAAEERMQVLESEGRQHLEEAERERREKEALQAELEKAVVRGKELGARLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSWLADKVKRLMRPRREGGPPGGLRLGADGAGSTESLGGPPETELPEGREADGTGSPSPAPMRRAQSSLCLRDETLAGGQRRKLSSRFPVGRSSESFSPGDTPRQRFRQRHPGPLGAPVSHSKGPGVGWENSAETLQEHETDANREGPEVQEPEKRPLTPSLSQ

SEQ ID NO: 31523 - protein, 587 aa, Homo sapiens
MSQMLHIEIPNFGNTVLGCLNEQRLLGLYCDVSIVVKGQAFKAHRAVLAASSLYFRDLFSGNSKSAFELPGSVPPACFQQILSFCYTGRLTMTASEQLVVMYTAGFLQIQHIVERGTDLMFKVSSPHCDSQTAVIEDAGSEPQSPCNQLQPAAAAAAPYVVSPSVPIPLLTRVKHEAMELPPAGPGLAPKRPLETGPRDGVAVAAGAAVAAGTAPLKLPRVSYYGVPSLATLIPGIQQMPYPQGERTSPGASSLPTTDSPTSYHNEEDEEDDEAYDTMVEEQYGQMYIKASGSYAVQEKPEPVPLESRSCVLIRRDLVALPASLISQIGYRCHPKLYSEGDPGEKLELVAGSGVYITRGQLMNCHLCAGVKHKVLLRRLLATFFDRNTLANSCGTGIRSSTSDPSRKPLDSRVLNAVKLYCQNFAPSFKESEMNVIAADMCTNARRVRKRWLPKIKSMLPEGVEMYRTVMGSAAASVPLDPEFPPAAAQVFEQRIYAERRGDAATIVALRTDAVNVDLSAAANPAFDAGEEVDGAGSVIQEVAAPEPLPADGQSPPQPFEQGGGGPSRPQTPAAAARRPEGTYAGTL

SEQ ID NO: 31524 - protein, 188 aa, Homo sapiens
MAEVEAPTAAETDMKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 31525 - protein, 483 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 31526 - protein, 289 aa, Homo sapiens
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQNAGLVTVTTTPLNCGPRLRVLLGRPAHEKLLMLLPVGYPSKEATVPDLKRKPLDQIMVTV

SEQ ID NO: 31527 - protein, 302 aa, Homo sapiens
MGLSTACSWGPRVLGIREHTVGQQLLDGAHQPLCKPRRSSSPDTIPPAPDGSIALPSLGSRGDLQGLLQGLPRQGAWHRLLDTTPITDRFAKTPKLQGLGRRPGLSGSVGTAARDDSLGSESGLWLRLSACVSSPVGWGIPWHPHDEQDAMGLSPGQTSVSFLWPLLEVRDHNTGRGLVPATVLTPGSPETLLELRQAFLGSRQARHGHDAAPSSGQQGCSVDRTAGRPVLGWRLRNSLTGQEGRQHLHLSGIRTSRKAKEYKPVFFGATEISVLMAVAESLREPPPPQWGWFLSSLFLKIF

SEQ ID NO: 31528 - protein, 302 aa, Homo sapiens [sequence omitted]

SEQ ID NO: 31529 - protein, 141 aa, Homo sapiens
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 31530 - protein, 141 aa, Homo sapiens; identical to SEQ ID NO: 31529

SEQ ID NO: 31531 - protein, 286 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPSTTQVVGILKIQVHYYEDGNVQLVSHKDIQDSLTVSNEVQTAKEFIKIVEAAENEYQTAISENYQTMSDTTFKALRRQLPVTRTKIDWNKILSYKIGKEMQNA

SEQ ID NO: 31532 - protein, 488 aa, Homo sapiens
MNFTPTHTPVCRKRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 31533 - protein, 828 aa, Homo sapiens
MRPRPEGRGLRAGVALSPALLLLLLLPPPPTLLGRLWAAGTPSPSAPGARQDGALGAGRVKRGWVWNQFFVVEEYTGTEPLYVGKIHSDSDEGDGAIKYTISGEGAGTIFLIDELTGDIHAMERLDREQKTFYTLRAQARDRATNRLLEPESEFIIKVQDINDSEPRFLHGPYIGSVAELSPTGTSVMQVMASDADDPTYGSSARLVYSVLDGEHHFTVDPKTGVIRTAVPDLDRESQERYEVVIQATDMAGQLGGLSGSTTVTIVVTDVNDNPPRFPQKMYQFSIQESAPIGTAVGRVKAEDSDVGENTDMTYHLKDESSSGGDVFKVTTDSDTQEAIIVVQKRLDFESQPVHTVILEALNKFVDPRFADLGTFRDQAIVRVAVTDVDEPPEFRPPSGLLEVQEDAQVGSLVGVVTARDPDAANRPVRYAIDRESDLDQIFDIDADTGAIVTGKGLDRETAGWHNITVLAMEADNHAQLSRASLRIRILDVNDNPPELATPYEAAVCEDAKPGQLIQTISVVDRDEPQGGHRFYFRLVPEAPSNPHFSLLDIQDNTAAVHTQHVGFNRQEQDVFFLPILVVDSGPPTLSSTGTLTIRICGCDSSGTIQSCNTTAFVMAASLSPGALIALLVCVLILVVLVLLILTLRRHHKSHLSSDEDEDMRDNVIKYNDEGGGEQDTEAYDMSALRSLYDFGELKGGDGGGSAGGGAGGGSGGGAGSPPQAHLPSERHSLPQGPPSPEPDFSVFRDFISRKVALADGDLSVPPYDAFQTYAFEGADSPAASLSSLHSGSSGSEQDFAYLSSWGPRFRPLAALYAGHRGDDEAQAS

SEQ ID NO: 31534 - protein, 118 aa, Homo sapiens
MATPSLRGRLARFGNPRKPVLKPNKPLILANRVGERRREKGEATCITEMSVMMACWKQNEFRDDACRKEIQGFLDCAARAQEARKMRSIQETLGESGSLLPNKLNKLLQRFPNKPYLS

SEQ ID NO: 31535 - protein, 183 aa, Homo sapiens
MENGAVYSPTTEEDPGPARGPRSGLAAYFFMGRLPLLRRVLKGLQLLLSLLAFICEEVVSQCTLCGGLYFFEFVSCSAFLLSLLILIVYCTPFYERVDTTKVKSSDFYITLGTGCVFLLASIIFVSTHDRTSAEIAAIVFGFIASFMFLLDFITMLYEKRQESQLRKPENTTRAEALTEPLNA

SEQ ID NO: 31536 - protein, 182 aa, Homo sapiens
MAQRSGKITLYEGKHFTGQKLEVFGDCDNFQDRGFMNRVNSIHVESGAWVCFNHPDFRGQQFILEHGDYPDFFRWNSHSDHMGSCRPVGMHGEHFRLEIFEGCNFTGQCLEFLEDSPFLQSRGWVKNCVNTIKVYGDGAAWSPRSFGAEDFQLSSSLQSDQGPEEATTKPATTQPPFLTANL

SEQ ID NO: 31537 - protein, 1279 aa, Homo sapiens
MGDVKNFLYAWCGKRKMTPTYEIRAVGNKNRQKFMCEVQVEGYNYTGMGNSTNKKDAQSNAARDFVNYLVRINEIKSEEVPAFGVASPPPLTDTPDTTANAEGDLPTHHGGPLLHILALKAENNSEVGASGYGVPGPTWDRGANLKDYYSRKEEQEVQATLESEEVDLNAGLHGNWTLENAKARLIQYFQKEKIQGEYKYTQVGPDHNRSFIAEMTIYIKQLGRRIFAREHGSNKKLAAQSCALSLVRQLYHLGVVEAYTGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESVLPRPHASIMFCTVGVLLRKLEAGIRGISHVIVDEIHERDINTSFLLVVLRDVVQAYPEVRIVFMSATIDTSMFCEYFFNCPSLKLWRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYSTVWASKTNLEQRKGRAGRSTAGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFVNEGKQLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMNYPSPFFVFGEKIRTRAISAKGMTLVPPLQLLLFASKKVQSDGQIVLVDDWIKLQISHEAAACITGLRAAMEALVVEVTKQPAIISQLDPVNERMLNMIRQISEPSAAGINLMIGSTRYGDGPRPPKMARYDNGSGYRRGGSSYSGGGYGGGYSSGGYGSGGYGGSATPSGRICAGVGGGYRGVSRGGFRGNSGGDYRGPSGGYRGSGGFQRGGGRGAYGTGYLDIEEEVAAIKLGYVSSVCRQ

SEQ ID NO: 31538 - protein, 235 aa, Homo sapiens
MKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYFGQGRGGGGY

SEQ ID NO: 31539 - protein, 273 aa, Homo sapiens
  MOD_RES 133,266: Xaa = Selenocysteine
MGILSVDLLITLQILPVFFSNCLFLALYDSVILLKHVVLLLSRSKSTRGEWRRMLTSEGLRCVWKSFLLDAYKQVKLGEDAPNSSVVHVSSTEGGDNSGNGTQEKIAEGATCHLLDFASPERPLVVNFGSATXPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRXKKTRLAG

SEQ ID NO: 31540 - protein, 309 aa, Homo sapiens
  MOD_RES 90,169,302: Xaa = Selenocysteine
MGILSVDLLITLQILPVFFSNCLFLALYDSVILLKHVVLLLSRSKSTRGEWRRMLTSEGLRCVWKSFLLDAYKQLNCPPSGFSKDGHILXLVYEAYKSRLLVYSHLDLWMVKLGEDAPNSSVVHVSSTEGGDNSGNGTQEKIAEGATCHLLDFASPERPLVVNFGSATXPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRXKKTRLAG

SEQ ID NO: 31541 - protein, 273 aa, Homo sapiens; identical to SEQ ID NO: 31539
  MOD_RES 133,266: Xaa = Selenocysteine

SEQ ID NO: 31542 - protein, 748 aa, Homo sapiens
MLGTLRAMEGEDVEDDQLLQKLRASRRRFQRRMQRLIEKYNQPFEDTPVVQMATLTYETPQGLRIWGGRLIKERNEGEIQDSSMKPADRTDGSVQAAAWGPELPSHRTVLGADSKSGEVDATSDQEESVAWALAPAVPQSPLKNELRRKYLTQVDILLQGAEYFECAGNRAGRDVRVTPLPSLASPAVPAPGYCSRISRKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 31543 - protein, 248 aa, Homo sapiens
MNKEYGKSFSRGSLVTRHQRIHTGKKPYECKECGKAFSCSSYFSQHQRIHTGEKPYECKECGKAFKYCSNLNDHQRIHTGEKPYECKVCGKAFTKSSQLFLHLRIHTGEKPYECKECGKAFTQHSRLIQHQRMHTGEKPYECKQCGKAFNSASTLTNHHRIHAGEKLYECEECRKAFIQSSELIQHQRIHTDEKPYECNECGKAFNKGSNLTRHQRIHTGEKPYDCKECGKAFGSRSDLIRHEGIHTG

SEQ ID NO: 31544 - protein, 315 aa, Homo sapiens
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQMEPKVVTDTDETELARQMERLERENAEVDGDDDAEEMEAKAED

SEQ ID NO: 31545 - protein, 422 aa, Homo sapiens
MVMVLSESLSTRGADSIACGTFSRELHTPKKMSQGPTLFSCGIMENDRWRDLDRKCPLQIDQPSTSIWECLPEKDSSLWHREAVTACAVTSLIKDLSISDHNGNPSAPPSKRQCRSLSFSDEMSSCRTSWRPLGSKVWTPVEKRRCYSGGSVQRYSNGFSTMQRSSSFSLPSRANVLSSPCDQAGLHHRFGGQPCQGVPGSAPCGQAGDTWSPDLHPVGGGRLDLQRSLSCSHEQFSFVEYCPPSANSTPASTPELARRSSGLSRSRSQPCVLNDKKVGVKRRRPEEVQEQRPSLDLAKMAQNCQTFSSLSCLSAGTEDCGPQSPFARHVSNTRAWTALLSASGPGGRTPAGTPVPEPLPPSFDDHLACQEDLSCEESDSCALDEDCGRRAEPAAAWRDRGAPGNSLCSLDGELDIEQIEKN

SEQ ID NO: 31546 - protein, 501 aa, Homo sapiens
MRAEEPCAPGAPSALGAQRTPGPELRLSSQLLPELCTFVVRVLFYLGPVYLAGYLGLSITWLLLGALLWMWWRRNRRGKLGRLAAAFEFLDNEREFISRELRGQHLPAWIHFPDVERVEWANKIISQTWPYLSMIMESKFREKLEPKIREKSIHLRTFTFTKLYFGQKCPRVNGVKAHTNTCNRRRVTVDLQICYIGDCEISVELQKIQAGVNGIQLQGTLRVILEPLLVDKPFVGAVTVFFLQKQHLQINWTGLTNLLDAPGINDVSDSLLEDLIATHLVLPNRVTVPVKKGLDLTNLRFPLPCGVIRVHLLEAEQLAQKDNFLGLRGKSDPYAKVSIGLQHFRSRTIYRNLNPTWNEVFEFMVYEVPGQDLEVDLYDEDTDRDDFLGSLQICLGDVMTNRVVDEWFVLNDTTSGRLHLRLEWLSLLTDQEVLTEDHGGLSTAILVVFLESACNLPRNPFDYLNGEYRAKKLSRFARVKQGQQRPFFLCQTICRQEDTYK

SEQ ID NO: 31547 - protein, 1430 aa, Homo sapiens
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEHQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEDVAALESQPLLGFTVIQVKDENSESKVFQLLHKNMLFYVFKAEDAHSAQKWIEAFQEGTIL

SEQ ID NO: 31548 - protein, 821 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31549 - protein, 822 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31550 - protein, 705 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31551 - protein, 254 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVGSQGL

SEQ ID NO: 31552 - protein, 822 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31553 - protein, 768 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 31554 - protein, 769 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 31555 - protein, 731 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31556 - protein, 366 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQGRRC

SEQ ID NO: 31557 - protein, 788 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEPYSPCYPDPR

SEQ ID NO: 31558 - protein, 732 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31559 - protein, 707 aa, Homo sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARRMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31560 - protein, 705 aa, Homo sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARRMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31561 - protein, 594 aa, Homo sapiens
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 31562 - protein, 326 aa, Homo sapiens
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 31563 - protein, 547 aa, Homo sapiens
MSTASSSSSSSSSQTPHPPSQRMRRSAAGSPPAVAAAGSGNGAGGGGGVGCAPAAGAGRLLQPIRATVPYQLLRGSQHSPTRPPVAAAAASLGSLPGPGAARGPSPSSPTPPAAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKDRQSPLHGNHITISHTQATGSRSVPMPLSNISVPKSSVSRVPCNVEGISPELEKVFIKENNGKEEVSKPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 31564 - protein, 68 aa, Homo sapiens
MSGSSSVAAMKKVVQQLRLEAGLNRVKVSQAAADLKQFCLQNAQHDPLLTGVSSSTNPFRPQKVCSFL

SEQ ID NO: 31565 - protein, 430 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 31566 - protein, 552 aa, Homo sapiens
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 31567 - protein, 413 aa, Homo sapiens
MKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAHRPDSPGGGLQAPGQKRTPRRGEQQGWNDSRGPEGMLERAERRSYREYRPYETERQADFTAEKFPDEKPGDRFDRDRPLRGRGGPRGGMRGRGRGGPGNRVFDAFDQRGKREFERYGGNDKIAVRTEDNMGGCGVRTWGSGKDTSDVEPTAPMEEPTVVEESQGTPEEESPAKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENNYPRAEVVMQDVAPNPDDPEDFPALS

SEQ ID NO: 31568 - protein, 453 aa, Homo sapiens
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRPGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKDWKKRFIGIRMRTITPSLVDELKASNPDFPEVSSGIYVQEVAPNSPSQRGGIQDGDIIVKVNGRPLVDSSELQEAVLTESPLLLEVRRGNDDLLFSIAPEVVM

SEQ ID NO: 31569 - protein, 155 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCR

SEQ ID NO: 31570 - protein, 149 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEVRSRSDH

SEQ ID NO: 31571 - protein, 822 aa, Homo sapiens
MSNAMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKMLGKKVTDTWAAALRIQKVWRRFHQRKETEKLREEEMIFLGMNPPPLFNEVSATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKGKKGKKKEKKAKKDKDLTADRTIESLYKELVEEGLLIQALKVNLSDYIGEYSYLGTTLRQVSIEPMPSLLDVRQLITLYGIWPLGSAAVHEKAPLVKSLLLAGPSGVGKKMLVHAICTETGANLFNLSSSNIAGKYPGKNGLQMMLHAVFKVARQLQPSVVWIEDTEKTFYKKVPNAEKMNEPKRLKKHLPQILKLLKPDDRILIVGTTRRPFDAELQSFCKVYQKIILVPRPDYASRYVLWKQIIERNGGVLTSALNVSCLAKVTDGFTQGHIVEVVKGVLTDQRIRRQIHKPLTAVEFITAITSMNPVYKEEEESFKNWYAKTPLGKKRALAITGGSTEKAKDKGKRK

SEQ ID NO: 31572 - protein, 642 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 31573 - protein, 221 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVY

SEQ ID NO: 31574 - protein, 230 aa, Homo sapiens
MGIQGMELCAMAVVVLLFIAVLKQFGILEPISMEDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 31575 - protein, 256 aa, Homo sapiens
MQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 31576 - protein, 904 aa, Homo sapiens
MEWGSESAAVRRHRVGVERREGAAAAPPPEREARAQEPLVDGCSGGGRTRKRSPGGSGGASRGAGTGLSEVRAALGLALYLIALRTLVQLSLQQLVLRGAAGHRGEFDALQARDYLEHITSIGPRTTGSPENEILTVHYLLEQIKLIEVQSNSLHKISVDVQRPTGSFSIDFLGGFTSYYDNITNVVVKLEPRDGAQHAVLANCHFDSVANSPGASDDAVSCSVMLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHGAQGKFIAFYLLGMFIPYLYALYLIWAVFEMFTPILGRSGSEIPPDVVLASILAGCTMILSSYFINFIYLAKSTKKTMLTLTLVCAITFLLVCSGTFFPYSSNPANPKPKRVFLQHMTRTFHDLEGNAVKRDSGIWINGFDYTGISHITPHIPEINDSIRAHCEENAPLCGFPWYLPVHFLIRKNWYLPAPEVSPRNPPHFRLISKEQTPWDSIKLTFEATGPSHMSFYVRAHKGSTLSQWSLGNGTPVTSKGGDYFVFYSHGLQASAWQFWIEVQVSEEHPEGMVTVAIAAHYLSGEDKRSPQLDALKEKFPDWTFPSAWVCTYDLFVF

SEQ ID NO: 31577 - protein, 688 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 31578 - protein, 736 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 31579 - protein, 736 aa, Homo sapiens; identical to SEQ ID NO: 31578

SEQ ID NO: 31580 - protein, 736 aa, Homo sapiens; identical to SEQ ID NO: 31578

SEQ ID NO: 31581 - protein, 736 aa, Homo sapiens; identical to SEQ ID NO: 31578

SEQ ID NO: 31582 - protein, 1609 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNPYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 31583 - protein, 325 aa, Homo sapiens
MANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 31584 - protein, 481 aa, Homo sapiens
MLLKCLHNNLCQKYSAHAFQFSPRNVLWLLVVCLRSDNKRPCLEFSQLSVKDSFRDLFIPRIETILMMYTRNNLNCAEPLFEQNNSLNVNFNTQKKTVWLIHGYRPVGSIPLWLQNFVRILLNEEDMNVIVVDWSRGATTFIYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNGLGIQEPLGHIDFYPNGGNKQPGCPKSIFSGIQFIKCNHQRAVHLFMASLETNCNFISFPCRSYKDYKTSLCVDCDCFKEKSCPRLGYQAKLFKGVLKERMEGRPLRTTVFLDTSGTYPFCTYYFVLSIIVPDKTMMDGSFSFKLLNQLGMIEEPRLYEKNKPFYKLQEVKILAQFYNDFVNISSIGLTYFQSSNLQCSTCTYKIQRLMLKSLTYPERPPLCRYNIVLKDREEVFLNPNTCTPKNT

SEQ ID NO: 31585 - protein, 91 aa, Homo sapiens
MGLEDEQKMLTESGDPEEEEEEEEELVDPLTTVREQCEQLEKCVKARERLELYDEHVSSRSHTEEDCTEELFDFLHAKDHCVAHKLFNNLK

SEQ ID NO: 31586 - protein, 91 aa, Homo sapiens; identical to SEQ ID NO: 31585

SEQ ID NO: 31587 - protein, 199 aa, Homo sapiens
MFHGTVTEELTSHEEWSHYNENIREGQKDFVFVKFNGLHLKSMENLQSCISLRVCIFSNNFITDIHPLQSCIKLIKLDLHGNQIKSLPNTKFWNGLKNLKLLYLHDNGFAKLKNICVLSACPTLIALTMFDCPVSLKKGYRHVLVNSIWPLKALDHHVISDEEIIQNWHLPERFKACNHRLFFNFCPALRKEKMKHSEV

SEQ ID NO: 31588 - protein, 297 aa, Homo sapiens
MMDSEAHEKRPPILTSSKQDISPHITNVGEMKHYLCGCCAAFNNVAITFPIQKVLFRQQLYGIKTRDAILQLRRDGFRNLYRGILPPLMQKTTTLALMFGLYEDLSCLLHKHVSAPEFATSGVAAVLAGTTEAIFTPLERVQTLLQDHKHHDKFTNTYQAFKALKCHGIGEYYRGLVPILFRNGLSNVLFFGLRGPIKEHLPTATTHSAHLVNDFICGGLLGAMLGFLFFPINVVKTRIQSQIGGEFQSFPKVFQKIWLERDRKLINLFRGAHLNYHRSLISWGIINATYEFLLKVI

SEQ ID NO: 31589 - protein, 475 aa, Homo sapiens
MTRGTGGTAQRGRSGPDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 31590 - protein, 462 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 31591 - protein, 878 aa, Homo sapiens
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKTLCKSANPQWQEHFDFHYFSDRMGILDIEVWGKDNKKHEERLGTCKVDISALPLKQANCLELPLDSCLGALLMLVTLTPCAGVSVSDLCVCPLADLSERKQITQRYCLQNPLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAVFLITVWNFELYMIPLALLLIFVYNFIRPVKGKVSSIQDSQESTDIDDEEDEDDKESEKKGLIERIYMVQDIVSTVQNVLEEIASFGERIKNTFNWTVPFLSSLACLILAAATIILYFIPLRYIILIWGINKFTKKLRNPYSIDNNELLDFLSRVPSDVQKVQYAELKLCSSHSPLRKKRSAL

SEQ ID NO: 31592 - protein, 126 aa, Homo sapiens
MWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 31593 - protein, 206 aa, Homo sapiens
MAAAVLGQLGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 31594 - protein, 727 aa, Homo sapiens
MNQKLLKLENLLRFHTIYRQLHSLCQRRALRQWRHGFSSAYPVWTAQLCAWPWPTDVLTGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQEDLKIIEEKRKEHKEAHQKAREKYGHLLWKKRSILRFLERKEQIPLKPKEKRERDSNVLSVIIKGDVDGSVEAILNIIDTYDASHECELELVHFGVGDVSANDVNLAETFDGVIYGFNVNAGNVIQQSAAKKGVKIKLHKIIYRLVEDLQEELSSRLPCAVEEHPVGEASILATFSVTEGKKKVPVAGCRVQKGQLEKQKKFKLTRNGHVIWKGSLTSLKHHKDDISIVKTGMDCGLSLDEDNMEFQVGDRIVCYEEKQIQAKTSWDPGF

SEQ ID NO: 31595 - protein, 727 aa, Homo sapiens; identical to SEQ ID NO: 31594

SEQ ID NO: 31596 - protein, 893 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 31597 - protein, 893 aa, Homo sapiens; identical to SEQ ID NO: 31596

SEQ ID NO: 31598 - protein, 1939 aa, Homo sapiens
MSSDSEMAIFGEAAPFLRKSERERIEAQNKPFDAKTSVFVVDPKESFVKATVQSREGGKVTAKTEAGATVTVKDDQVFPMNPPKYDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEVTSGKMQGTLEDQIISANPLLEAFGNAKTVRNDNSSRFGKFIRIHFGTTGKLASADIETYLLEKSRVTFQLKAERSYHIFYQIMSNKKPDLIEMLLITTNPYDYAFVSQGEITVPSIDDQEELMATDSAIEILGFTSDERVSIYKLTGAVMHYGNMKFKQKQREEQAEPDGTEVADKAAYLQNLNSADLLKALCYPRVKVGNEYVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYEQHLGKSNNFQKPKPAKGKPEAHFSLIHYAGTVDYNIAGWLDKNKDPLNETVVGLYQKSAMKTLALLFVGATGAEAEAGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGLLEEMRDEKLAQLITRTQAMCRGFLARVEYQKMVERRESIFCIQYNVRAFMNVKHWPWMKLYFKIKPLLKSAETEKEMANMKEEFEKTKEELAKTEAKRKELEEKMVTLMQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKIRMDLERAKRKLEGDLKLAQESAMDIENDKQQLDEKLKKKEFEMSGLQSKIEDEQALGMQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNMETVSKAKGNLEKMCRALEDQLSEIKTKEEEQQRLINDLTAQRARLQTESGEYSRQLDEKDTLVSQLSRGKQAFTQQIEELKRQLEEEIKAKSALAHALQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERTNAACAALDKKQRNFDKILAEWKQKCEETHAELEASQKESRSLSTELFKIKNAYEESLDQLETLKRENKNLQQEISDLTEQIAEGGKRIHELEKIKKQVEQEKSELQAALEEAEASLEHEEGKILRIQLELNQVKSEVDRKIAEKDEEIDQMKRNHIRIVESMQSTLDAEIRSRNDAIRLKKKMEGDLNEMEIQLNHANRMAAEALRNYRNTQAILKDTQLHLDDALRSQEDLKEQLAMVERRANLLQAEIEELRATLEQTERSRKIAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVEAVKGLRKHERKVKELTYQTEEDRKNILRLQDLVDKLQAKVKSYKRQAEEAEEQSNVNLSKFRRIQHELEEAEERADIAESQVNKLRVKSREVHTKIISEE

SEQ ID NO: 31599 - protein, 1941 aa, Homo sapiens
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQGAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVVFQLKAERSYHIFYQITSNKKPELIEMLLITTNPYDYPFVSQGEISVASIDDQEELMATDSAIDILGFTNEEKVSIYKLTGAVMHYGNLKFKQKQREEQAEPDGTEVADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLASIDIDHTQYKFGHTKVFFKAGLLGLLEEMRDDKLAQLITRTQARCRGFLARVEYQRMVERREAIFCIQYNIRSFMNVKHWPWMKLFFKIKPLLKSAETEKEMATMKEEFQKIKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKLRMDLERAKRKLEGDLKLAQESIMDIENEKQQLDEKLKKKEFEISNLQSKIEDEQALGIQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNVETVSKAKGNLEKMCRTLEDQLSELKSKEEEQQRLINDLTAQRGRLQTESGEFSRQLDEKEALVSQLSRGKQAFTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKCEETHAELEASQKEARSLGTELFKIKNAYEESLDQLETLKRENKNLQQEISDLTEQIAEGGKRIHELEKIKKQVEQEKCELQAALEEAEASLEHEEGKILRIQLELNQVKSEVDRKIAEKDEEIDQLKRNHIRIVESMQSTLDAEIRSRNDAIRLKKKMEGDLNEMEIQLNHANRMAAEALRNYRNTQGILKDTQIHLDDALRSQEDLKEQLAMVERRANLLQAEIEELRATLEQTERSRKIAEQELLDASERVQLLHTQNTSLINTKKKLETDISQMQGEMEDILQEARNAEEKAKKAITDAAMMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKLQHELEEAEERADIAESQVNKLRVKSREVHTKVISEE

SEQ ID NO: 31600 - protein, 1940 aa, Homo sapiens
MSSDTEMEVFGIAAPFLRKSEKERIEAQNQPFDAKTYCFVVDSKEEYAKGKIKSSQDGKVTVETEDNRTLVVKPEDVYAMNPPKFDRIEDMAMLTHLNEPAVLYNLKDRYTSWMIYTYSGLFCVTVNPYKWLPVYNPEVVEGYRGKKRQEAPPHIFSISDNAYQFMLTDRENQSILITGESGAGKTVNTKRVIQYFATIAATGDLAKKKDSKMKGTLEDQIISANPLLEAFGNAKTVRNDNSSRFGKFIRIHFGTTGKLASADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAILEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVATLRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAQEKLAQRLQDSEEQVEAVNAKCASLEKTKQRLQGEVEDLMVDVERANSLAAALDKKQRNFDKVLAEWKTKCEESQAELEASLKESRSLSTELFKLKNAYEEALDQLETVKRENKNLEQEIADLTEQIAENGKTIHELEKSRKQIELEKADIQLALEEAEAALEHEEAKILRIQLELTQVKSEIDRKIAEKDEEIEQLKRNYQRTVETMQSALDAEVRSRNEAIRLKKKMEGDLNEIEIQLSHANRQAAETLKHLRSVQGQLKDTQLHLDDALRGQEDLKEQLAIVERRANLLQAEVEELRATLEQTERARKLAEQELLDSNERVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQKKNTESVKGLRKYERRVKELTYQSEEDRKNVLRLQDLVDKLQVKVKSYKRQAEEADEQANAHLTKFRKAQHELEEAEERADIAESQVNKLRAKTRDFTSSRMVVHESEE

SEQ ID NO: 31601 - protein, 1939 aa, Homo sapiens
MSSDSEMAIFGEAAPFLRKSEKERIEAQNKPFDAKTSVFVVDPKESYVKAIVQSREGGKVTAKTEAGATVTVKEDQVFSMNPPKYDKIEDMAMMTHLHEPAVLYNLKERYAAWMIYTYSGLFCVTVNPYKWLPVYNPEVVTAYRGKKRQEAPPHIFSISDNAYQFMLTDRENQSILITGESGAGKTVNTKRVIQYFATIAVTGEKKKEEPASGKMQGTLEDQIISANPLLEAFGNAKTVRNDNSSRFGKFIRIHFGATGKLASADIETYLLEKSRVTFQLKAERSYHIFYQILSNKKPELIEMLLITTNPYDFAFVSQGEITVPSIDDQEELMATDSAVDILGFTADEKVAIYKLTGAVMHYGNMKFKQKQREEQAEPDGTEVADKAAYLTSLNSADLLKSLCYPRVKVGNEFVTKGQTVQQVYNAVGALAKAIYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYEQHLGKSNNFQKPKPAKGKPEAHFSLVHYAGTVDYNIAGWLDKNKDPLNETVVGLYQKSAMKTLAFLFSGAQTAEAEGGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIEIDHTQYKFGHTKVFFKAGLLGTLEEMRDEKLAQLITRTQAICRGFLMRVEFRKMMERRESIFCIQYNIRAFMNVKHWPWMKLYFKIKPLLKSAETEKEMANMKEEFEKTKEELAKTEAKRKELEEKMVTLMQEKNDLQLQVQAEADALADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQMEEDKVNTLTKAKTKLEQQVDDLEGSLEQEKKLCMDLERAKRKLEGDLKLAQESTMDTENDKQQLNEKLKKKEFEMSNLQGKIEDEQALAMQLQKKIKELQARIEELEEEIEAERASRAKAEKQRSDLSRELEEISERLEEAGGATSAQIELNKKREAEFQKMRRDLEESTLQHEATAAALRKKHADSVAELGKQIDSLQRVKQKLEKEKSELKMEINDLASNMETVSKAKANFEKMCRTLEDQLSEIKTKEEEQQRLINELSAQKARLHTESGEFSRQLDEKDAMVSQLSRGKQAFTQQIEELKRQLEEETKAKSTLAHALQSARHDCDLLREQYEEEQEAKAELQRGMSKANSEVAQWRTKYETDAIQRTEELEEAKKKLAQRLQDAEEHVEAVNSKCASLEKTKQRLQNEVEDLMIDVERSNAACIALDKKQRNFDKVLAEWKQKYEETQAELEASQKESRSLSTELFKVKNAYEESLDHLETLKRENKNLQQEISDLTEQIAEGGKHIHELEKVKKQLDHEKSELQTSLEEAEASLEHEEGKILRIQLELNQVKSEIDRKIAEKDEELDQLKRNHLRVVESMQSTLDAEIRSRNDALRIKKKMEGDLNEMEIQLNHANRQAAEALRNLRNTQGILKDTQLHLDDAIRGQDDLKEQLAMVERRANLMQAEVEELRASLERTERGRKMAEQELLDASERVQLLHTQNTSLINTKKKLETDISQIQGEMEDIVQEARNAEEKAKKAITDAAMMAEELKKEQDTSAHLERMKKNMEQTVKDLQLRLGEAEQLALKGGKKQIQKLEARVRELESEVESEQKHNVEAVKGLRKHERRVKELTYQTEEDRKNILRLQDLVDKLQTKVKAYKRQAEEAEEQSNVNLAKFRKLQHELEEAEERADIAESQVNKLRVKSREVHTKVISEE

SEQ ID NO: 31602 - protein, 1937 aa, Homo sapiens
MSASSDAEMAVFGEAAPYLRKSEKERIEAQNKPFDAKTSVFVAEPKESYVKSTIQSKEGGKVTVKTEGGATLTVREDQVFPMNPPKYDKIEDMAMMTHLHEPGVLYNLKERYAAWMIYTYSGLFCVTVNPYKWLPVYKPEVVAAYRGKKRQEAPPHIFSISDNAYQFMLTDRENQSILITGESGAGKTVNTKRVIQYFATIAVTGEKKKDESGKMQGTLEDQIISANPLLEAFGNAKTVRNDNSSRFGKFIRIHFGTTGKLASADIETYLLEKSRVTFQLKAERSYHIFYQITSNKKPDLIEMLLITTNPYDYAFVSQGEITVPSIDDQEELMATDSAIDILGFTPEEKVSIYKLTGAVMHYGNMKFKQKQREEQAEPDGTEVADKAAYLQSLNSADLLKALCYPRVKVGNEYVTKGQTVQQVYNAVGALAKAVYEKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPLGIFSILEEECMFPKATDTSFKNKLYDQHLGKSANFQKPKVVKGKAEAHFSLIHYAGTVDYNITGWLDKNKDPLNDTVVGLYQKSAMKTLASLFSTYASAEADSSAKKGAKKKGSSFQTVSALFRENLNKLMTNLRSTHPHFVRCIIPNETKTPGAMEHELVLHQLRCNGVLEGIRICRKGFPSRILYGDFKQRYKVLNASAIPEGQFIDSKKASEKLLASIDIDHTQYKFGHTKVFFKAGLLGLLEEMRDEKLAQIITRTQAVCRGFLMRVEYQKMLQRREALFCIQYNVRAFMNVKHWPWMKLFFKIKPLLKSAETEKEMATMKEEFQKTKDELAKSEAKRKELEEKMVTLLKEKNDLQLQVQSEADSLADAEERCEQLIKNKIQLEAKIKEVTERAEEEEEINAELTAKKRKLEDECSELKKDIDDLELTLAKVEKQKHATENKVKNLTEEMAGLDETIAKLSKEKKALQETHQQTLDDLQAEEDKVNILTKAKTKLEQQVDDLEGSLEQEKKLRMDLERAKRKLEGDLKLAQESTMDMENDKQQLDEKLEKKEFEISNLISKIEDEQAVEIQLQKKIKELQARIEELGEEIEAERASRAKAEKQRSDLSRELEEISERLEEAGGATSAQVELNKKREAEFQKLRRDLEEATLQHEAMVAALRKKHADSMAELGEQIDNLQRVKQKLEKEKSELKMETDDLSSNAEAISKAKGHLEKMCRSLEDQVSGLKTKEEEQQRLINDLTAQRARLQTEAGEYSRQLDEQDALVSQLSRSKQASTQQIEELKHQLEEETKAKNALAHALQSSRHDCDLLREQYEEEQEGKAELQRALSKANSEVAQWRTKYETDAIQRTEELEEAKKKLAQRLQEAEEHVEAVNAKCASLEKTKQRLQNEVEDLMLDVERSNAACAALDKKQRNFDKVLSEWKQKYEETQAELEASQKESRSLSTELFKVKNVYEESLDQLETLRRAHKNLQQEISDLTEQIAEGGKQIHELEKIKKQVEQEKCEIQAALEEAEASLEHEEGKILRIQLELNQVKSEVDRKIAEKDEEIDQLKRNHTRVVETMQSTLDAEIRSRNDALRVKKKMEGDLNEMEIQLNHANRLAAESLRNYRNTQGILKETQLHLDDALRGQEDLKEQLAIVERRANLLQAEIEELWATLEQTERSRKIAEQELLDASERVQLLHTQNTSLINTKKKLENDVSQLQSEVEEVIQESRNAEEKAKKAITDAAMMAEELKKEQDTSAHLERMKKNLEQTVKDLQHRLDEAEQLALKGGKKQIQKLEARVRELEGEVENEQKRNAEAVKGLRKHDRRVKELTYQTEEDRKNVLRLQDLVDKLQAKVKSYKRQAEEAEEQSNANLSKFRKLQHELEEAEERADIAESQVNKLRVKSREVHTKISAE

SEQ ID NO: 31603 - protein, 137 aa, Homo sapiens
MGAHLVRRYLGDASVEPDPLQMPTFPPDYGFPERKEREMVATQQEMMDAQLRLQLRDYCAHHLIRLLKCKRDSFPNFLACKQERHDWDYCEHRDYVMRMKEFERERRLLQRKKRREKKAAELAKGQGPGEVDPKVAL

SEQ ID NO: 31604 - protein, 420 aa, Homo sapiens
MMYSPICLTQDEFHPFMEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 31605 - protein, 279 aa, Homo sapiens
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPTLERPGRKRKWTETQDSSQKKSLEPKTKAVPKVKLLCGADLLESFAVPNLWKSEDITQIVANYGLICVTRAGNDAQKFIYESDVLWKHRSNIHVVNEWIANDISSTKIRRALRRGQSIRYLVPDLVQEYIEKHNLYSSESEDRNAGVILAPLQRNTAEAKT

SEQ ID NO: 31606 - protein, 591 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKAGSRGRFAGHSEAGGGSGDRRRAGPEKRPKSSREGSGGPQESSRDKRPLSGPDVGTPQPAGLASGAKLAAGRPFNTYPRADTDHPSRGAQGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 31607 - protein, 591 aa, Homo sapiens; identical to SEQ ID NO: 31606

SEQ ID NO: 31608 - protein, 426 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 31609 - protein, 438 aa, Homo sapiens
MFGKRKKRVEISAPSNFEHRVHTGFDQHEQKFTGLPRQWQSLIEESARRPKPLVDPACITSIQPGAPKGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 31610 - protein, 438 aa, Homo sapiens; identical to SEQ ID NO: 31609

SEQ ID NO: 31611 - protein, 591 aa, Homo sapiens; identical to SEQ ID NO: 31606

SEQ ID NO: 31612 - protein, 450 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVADPHSPFAIKQETPEVSSSSSTPSSLSSSAFLDLQQVGSGVPPFNAFPHAASVYGQFTGQALLSGREMVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 31613 - protein, 387 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVAGREMVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 31614 - protein, 398 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVAAPPFWICSKSAPGSRPSMPFPMLPPCTGSSRARPSSQGERWWGPRCPDTHPTSPPADRAAMPPLPSQAWWQEVNTLAMPMATPPTPPTARPGASPTPAC

SEQ ID NO: 31615 - protein, 321 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGERWWGPRCPDTHPTSPPADRAAMPPLPSQAWWQEVNTLAMPMATPPTPPTARPGASPTPAC

SEQ ID NO: 31616 - protein, 287 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQEVNTLAMPMATPPTPPTARPGASPTPAC

SEQ ID NO: 31617 - protein, 4243 aa, Homo sapiens
MGHLWLLGIWGLCGLLLCAADPSTDGSQIIPKVTEIIPKYGSINGATRLTIRGEGFSQANQFNYGVDNAELGNSVQLISSFQSITCDVEKDASHSTQITCYTRAMPEDSYTVRVSVDGVPVTENNTCKGHINSWECTFNAKSFRTPTIRSITPLSGTPGTLITIQGRIFTDVYGSNIALSSNGKNVRILRVYIGGMPCELLIPQSDNLYGLKLDHPNGDMGSMVCKTTGTFIGHHNVSFILDNDYGRSFPQKMAYFVSSLNKIAMFQTYAEVTMIFPSQGSIRGGTTLTISGRFFDQTDFPVRVLVGGEPCDILNVTENSICCKTPPKPHILKTVYPGGRGLKLEVWNNSRPIRLEEILEYNEKTPGYMGASWVDSASYIWLMEQDTFVARFSGFLVAPDSDVYRFYIKGDDRYAIYFSQTGLPEDKVRIAYHSANANSYFSSPTQRSDDIHLQKGKEYYIEILLQEYRLSAFVDVGLYQYRNVYTEQQTGDAVNEEQVIKSQSTILQEVQVITLENWETTNAINEVQKIKVTSPCVEANSCSLYQYRLIYNMEKTVFLPADASEFILQSALNDLWSIKPDTVQVIRTQNPQSYVYMVTFISTRGDFDLLGYEVVEGNNVTLDITEQTKGKPNLETFTLNWDGIASKPLTLWSSEAEFQGAVEEMVSTKCPPQIANFEEGFVVKYFRDYETDFNLEHINRGQKTAETDAYCGRYSLKNPAVLFDSADVKPNRRPYGDILLFPYNQLCLAYKGFLANYIGLKFQYQDNSKITRSTDTQFTYNFAYGNNWTYTCIDLLDLVRTKYTGTNVSLQRISLHKASESQSFYVDVVYIGHTSTISTLDEMPKRRLPALANKGIFLEHFQVNQTKTNGPTMTNQYSVTMTSYNCSYNIPMMAVSFGQIITHETENEFVYRGNNWPGESKIHIQRIQAASPPLSGSFDIQAYGHILKGLPAAVSAADLQFALQSLEGMGRISVTREGTCAGYAWNIKWRSTCGKQNLLQINDSNIIGEKANMTVTRIKEGGLFRQHVLGDLLRTPSQQPQVEVYVNGIPAKCSGDCGFTWDSNITPLVLAISPSQGSYEEGTILTIVGSGFSPSSAVTVSVGPVGCSLLSVDEKELKCQILNGSAGHAPVAVSMADVGLAQNVGGEEFYFVYQSQISHIWPDSGSIAGGTLLTLSGFGFNENSKVLVGNETCNVIEGDLNRITCRTPKKTEGTVDISVTTNGFQATARDAFSYNCLQTPIITDFSPKVRTILGEVNLTIKGYNFGNELTQNMAVYVGGKTCQILHWNFTDIRCLLPKLSPGKHDIYVEVRNWGFASTRDKLNSSIQYVLEVTSMFPQRGSLFGGTEITIRGFGFSTIPAENTVLLGSIPCNVTSSSENVIKCILHSTGNIFRITNNGKDSVHGLGYAWSPPVLNVSVGDTVAWHWQTHPFLRGIGYRIFSVSSPGSVIYDGKGFTSGRQKSTSGSFSYQFTSPGIHYYSSGYVDEAHSIFLQGVINVLPAETRHIPLHLFVGRSEATYAYGGPENLHLGSSVAGCLATEPLCSLNNTRVKNSKRLLFEVSSCFSPSISNITPSTGTVNELITIIGHGFSNLPWANKVTIGSYPCVVEESSEDSITCHIDPQNSMDVGIRETVTLTVYNLGTAINTLSNEFDRRFVLLPNIDLVLPNAGSTTGMTSVTIKGSGFAVSSAGVKVLMGHFPCKVLSVNYTAIECETSPAAQQLVDVDLLIHGVPAQCQGNCTFSYLESITPYITGVFPNSVIGSVKVLIEGEGLGTVLEDIAVFIGNQQFRAIEVNENNITALVTPLPVGHHSVSVVVGSKGLALGNLTVSSPPVASLSPTSGSIGGGTTLVITGNGFYPGNTTVTIGDEPCQIISINPNEVYCRTPAGTTGMVDVKIFVNTIAYPPLLFTYALEDTPFLRGIIPSRGPPGTEIEITGSNFGFEILEISVMINNIQCNVTMANDSVLQCIVGDHAGGTFPVMMHHKTKGSAMSTVVFEYPLNIQNINPSQGSFGGGQTMTVTGTGFNPQNSIILVCGSECAIDRLRSDYTTLLCEIPSNNGTGAEQACEVSVVNGKDLSQSMTPFTYAVSLTPLITAVSPKRGSTAGGTRLTVVGSGFSENMEDVHITIAEAKCDVEYSNKTHIICMTDAHTLSGWAPVCVHIRGVGMAKLDNADFLYVDAWSSNFSWGGKSPPEEGSLVVITKGQTILLDQSTPILKMLLIQGGTLIFDEADIELQAENILITDGGVLQIGTETSPFQHKAVITLHGHLRSPELPVYGAKTLAVREGILDLHGVPVPVTWTRLAHTAKAGERILILQEAVTWKPGDNIVIASTGHRHSQGENEKMTIASVSADGINITLSNPLNYTHLGITVTLPDGTLFEARAEVGILTRNILIRGSDNVEWNNKIPACPDGFDTGEFATQTCLQGKFGEEIGSDQFGGCVMFHAPVPGANMVTGRIEYVEVFHAGQAFRLGRYPIHWHLLGDLQFKSYVRGCAIHQAYNRAVTIHNTHHLLVERNIIYDIKGGAFFIEDGIEHGNILQYNLAVFVQQSTSLLNDDVTPAAFWVTNPNNTIRHNAVAGGTHFGFWYRMNNHPDGPSYDRNICQKRVPLGEFFNNTVHSQGWFGMWIFEEYFPMQTGSCTSTVPAPAIFNSLTTWNCQKGAEWVNGGALQFHNFVMVNNYEAGIETKRILAPYVGGWGETNGAVIKNAKIVGHLDELGMGSAFCTAKGLVLPFSEGLTVSSVHFMNFDRPNCVALGVTSISGVCNDRCGGWSAKFVDVQYSHTPNKAGFRWEHEMVMIDVDGSLTGHKGHTVIPHSSLLDPSHCTQEAEWSIGFPGSVCDASVSFHRLAFNQPSPVSLLEKDVVLSDSFGTSIIPFQKKRLTHMSGWMALIPNANHINWYFKGVDHITNISYTSTFYGFKEEDYVIISHNFTQNPDMFNIIDMRNGSSNPLNWNTSKNGDWHLEANTSTLYYLVSGRNDLHQSQLISGNLDPDVKDVVINFQAYCCILQDCFPVHPPSRKPIPKKRPATYNLWSNDSFWQSSRENNYTVPHPGANVIIPEGTWIVADIDMPSMERLIIWGVLELEDKYNVGAAESSYREVVLNATYISLQGGRLIGGWEDNPFKGDLKIVLRGNHTTQDWALPEGPNQGAKVLGVFGELDLHGIPHSIYKTKLSETAFAGSKVLSLMDAVDWQEGEEIVITTTSYDFHQTETRSIVKILHDHKILILNDSLSYTHFAEKYHVPGTGESYTLAADVGILSRNIKIVGEDYPGWSEDSFGARVLVGSFTENMMTFKGNARISNVEFYHSGQEGFRDSTDPRYAVTFLNLGQIQEHGSSYIRGCAFHHGFSPAIGVFGTDGLDIDDNIIHFTVGEGIRIWGNANRVRGNLIALSVWPGTYQNRKDLSSTLWHAAIEINRGTNTVLQNNVVAGFGRAGYRIDGEPCPGQFNPVEKWFDNEAHGGLYGIYMNQDGLPGCSLIQGFTIWTCWDYGIYFQTTESVHIYNVTLVDNGMAIFPMIYMPAAISHKISSKNVQIKSSLIVGSSPGFNCSDVLTNDDPNIELTAAHRSPRSPSGGRSGICWPTFASAHNMAPRKPHAGIMSYNAISGLLDISGSTFVGFKNVCSGETNVIFITNPLNEDLQHPIHVKNIKLVDTTEQSKIFIHRPDISKVNPSDCVDMVCDAKRKSFLRDIDGSFLGNAGSVIPQAEYEWDGNSQVGIGDYRIPKAMLTFLNGSRIPVTEKAPHKGIIRDSTCKYLPEWQSYQCFGMEYAMMVIESLDPDTETRRLSPVAIMGNGYVDLINGPQDHGWCAGYTCQRRLSLFHSIVALNKSYEVYFTGTSPQNLRLMLLNVDHNKAVLVGIFFSTLQRLDVYVNNLLVCPKTTIWNAQQKHCELNNHLYKDQFLPNLDSTVLGENYFDGTYQMLYLLVKGTIPVEIHTATVIFVSFQLSVATEDDFYTSHNLVKNLALFLKIPSDKIRISKIRGKSLRRKRSMGFIIEIEIGDPPIQFISNGTTGQMQLSELQEIAGSLGQAVILGNISSILGFNISSMSITNPLPSPSDSGWIKVTAQPVERSAFPVHHVAFVSSLLVITQPVAAQPGQPFPQQPSVKATDSDGNCVSVGITALTLRAILKDSNNNQVNGLSGNTTIPFSSCWANYTDLTPLRTGKNYKIEFILDNVVGVESRTFSLLAESVSSSGSSSSSNSKASTVGTYAQIMTVVISCLVGRMWLLEIFMAAVSTLNITLRSY

SEQ ID NO: 31618 - protein, 417 aa, Homo sapiens
MDVERLQEALKDFEKRGKKEVCPVLDQFLCHVAKTGETMIQWSQFKGYFIFKLEKVMDDFRTSAPEPRGPPNPNVEYIPFDEMKERILKIVTGFNGIPFTIQRLCELLTDPRRNYTGTDKFLRGVEKNVMVVSCVYPSSEKNNSNSLNRMNGVMFPGNSPSYTERSNINGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEESFMTSREMIPERKNQEKESDDALTVNEETSEENNQMEESDVSQAEKDLLHSEGSENEGPVSSSSSDCRETEELVGSNSSKTGEILSESSMENDDEATEVTDEPMEQD

SEQ ID NO: 31619 - protein, 1150 aa, Homo sapiens
MAPPLRPLARLRPPGMLLRALLLLLLLSPLPGVWCFSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSTISAFEVQPISTEVHEGGVARFACKISSHPPAVITWEFNRTTLPMTMDRITALPTGVLQIYDVSQRDSGNYRCIAATVAHRRKSMEASLTVIPAKESKSFHTPTIIAGPQNITTSLHQTVVLECMATGNPKPIISWSRLDHKSIDVFNTRVLGNGNLMISDVRLQHAGVYVCRATTPGTRNFTVAMATLTVLAPPSFVEWPESLTRPRAGTARFVCQAEGIPSPKMSWLKNGRKIHSNGRIKMYNSKLVINQIIPEDDAIYQCMAENSQGSILSRARLTVVMSEDRPSAPYNVHAETMSSSAILLAWERPLYNSDKVIAYSVHYMKAEGLNNEEYQVVIGNDTTHYIIDDLEPASNYTFYIVAYMPMGASQMSDHVTQNTLEDVPLRPPEISLTSRSPTDILISWLPIPAKYRRGQVVLYRLSFRLSTENSIQVLELPGTTHEYLLEGLKPDSVYLVRITAATRVGLGESSVWTSHRTPKATSVKAPKSPELHLEPLNCTTISVRWQQDVEDTAAIQGYKLYYKEEGQQENGPIFLDTKDLLYTLSGLDPRRKYHVRLLAYNNIDDGYQADQTVSTPGCVSVRDRMVPPPPPPHHLYAKANTSSSIFLHWRRPAFTAAQIINYTIRCNPVGLQNASLVLYLQTSETHMLVQGLEPNTKYEFAVRLHVDQLSSPWSPVVYHSTLPEAPAGPPVGVKVTLIEDDTALVSWKPPDGPETVVTRYTILYASRKAWIAGEWQVLHREGAITMALLENLVAGNVYIVKISASNEVGEGPFSNSVELAVLPKETSESNQRPKRLDSADAKVYSGYYHLDQKSMTGIAVGVGIALTCILICVLILIYRSKARKSSASKTAQNGTQQLPRTSASLASGNEVGKNLEGAVGNEESLMPMIMPNSFIDAKGGTDLIINSYGPIIKNNSKKKWFFFQDSKKIQVEQPQRRFTPAVCFYQPGTTVLISDEDSPSSPGQTTSFSRPFGVAADTEHSANSEGSHETGDSGRFSHESNDEIHLSSVISTTPPNL

SEQ ID NO: 31620 - protein, 1989 aa, Homo sapiens
MATADTPAPASSGLSPKEEGELEDGEISDDDNNSQIRSRSSSSSSGGGLLPYPRRRPPHSARGGGSGGGGGSSSSSSSSQQQLRNFSRSRHASERGHLRGPSSYRPKEPFRSHPPSVRMPSSSLSESSPRPSFWERSHLALDRFRFRGRPYRGGSRWSRGRGVGERGGKPGCRPPLGGGAGSGFSSSQSWREPSPPRKSSKSFGRSPSRKQNYSSKNENCVEETFEDLLLKYKQIQLELECINKDEKLALSSKEENVQEDPKTLNFEDQTSTDNVSITKDSSKEVAPEEKTQVKTFQAFELKPLRQKLTLPGDKNRLKKVKDGAKPLSLKSDTTDSSQGLQDKEQNLTRRISTSDILSEKKLGEDEEELSELQLRLLALQSASKKWQQKEQQVMKESKEKLTKTKTVQQKVKTSTKTHSAKKVSTTAKQALRKQQTKAWKKLQQQKEQERQKEEDQRKQAEEEERRKREEEIRKIRDLSNQEEQYNRFMKLVGGKRRSRSKSSDPDLRRSLDKQPTDSGGGIYQYDNYEEVAMDTDSETSSPAPSPVQPPFFSECSLGYFSPAPSLSLPPPPQVSSLPPLSQPYVEGLCVSLEPLPPLPPLPPLPPEDPEQPPKPPFADEEEEEEMLLREELLKSLANKRAFKPEETSSNSDPPSPPVLNNSHPVPRSNLSIVSINTVSQPRIQNPKFHRGPRLPRTVISLPKHKSVVVTLNDSDDSESDGEASKSTNSVFGGLESMIKEARRTAEQASKPKVPPKSEKENDPLRTPEALPEEKKIEYRLLKEEIANREKQRLIKSDQLKTSSSSPANSDVEIDGIGRIAMVTKQVTDAESKLKKHRILLMKDESVLKNLVQQEAKKKESVRNAEAKITKLTEQLQATEKILNVNRMFLKKLQEQIHRVQQRVTIKKALTLKYGEELARAKAVASKEIGKRKLEQDRFGPNKMMRLDSSPVSSPRKHSAELIAMEKRRLQKLEYEYALKIQKLKEARALKAKEQQNISPVVEEEPEFSLPQPSLHDLTQDKLTLDTEENDVDDEILSGSSRERRRSFLESNYFTKPNLKHTDTANKECINKLNKNTVEKPELFLGLKIGELQKLYSKADSLKQLILKTTTGITEKVLHGQEISVDVDFVTAQSKTMEVKPCPFRPYHSPLLVFKSYRFSPYYRTKEKLPLSSVSYSNMIEPDQCFCRFDLTGTCNDDDCQWQHIQDYTLSRKQLFQDILSYNLSLIGCAETSTNEEITASAEKYVEKLFGVNKDRMSMDQMAVLLVSNINESKGHTPPFTTYKDKRKWKPKFWRKPISDNSFSSDEEQSTGPIKYAFQPENQINVPALDTVVTPDDVRYFTNETDDIANLEASVLENPSHVQLWLKLAYKYLNQNEGECSESLDSALNVLARALENNKDNPEIWCHYLRLFSKRGTKDEVQEMCETAVEYAPDYQSFWTFLHLESTFEEKDYVCERMLEFLMGAAKQETSNILSFQLLEALLFRVQLHIFTGRCQSALAILQNALKSANDGIVAEYLKTSDRCLAWLAYIHLIEFNILPSKFYDPSNDNPSRIVNTESFVMPWQAVQDVKTNPDMLLAVFEDAVKACTDESLAVEERIEACLPLYTNMIALHQLLERYEAAMELCKSLLESCPINCQLLEALVALYLQTNQHDKARAVWLTAFEKNPQNAEVFYHMCKFFILQNRGDNLLPFLRKFIASFFKPGFEKYNNLDLFRYLLNIPGPIDIPSRLCKGNFDDDMFNHQVPYLWLIYCLCHPLQSSIKETVEAYEAALGVAMRCDIVQKIWMDYLVFANNRAAGSRNKVQEFKFFTDLVNRCLVTVPARYPIPFSSADYWSNYEFHNRVIFFYLSCVPKTQHSKTLERFCSVMPANSGLALRLLQHEWEESNVQILKLQAKMFTYNIPTCLATWKIAIAAEIVLKGQREVHRLYQRALQKLPLCASLWKDQLLFEASEGGKTDNLRKLVSKCQEIGVSLNELLNLNSNKTESKNH

SEQ ID NO: 31621 - protein, 425 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQAPLLPTSTVIDPSRFCAQPFRWFLDLSFPAMSSSHPQLPLTLASFKLLREPCSVQLS

SEQ ID NO: 31622 - protein, 400 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEMGPDGRCFCHAWRQVPRTWCSSREPCSVQLS

SEQ ID NO: 31623 - protein, 393 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQEMGPDGRCFCHAWRQVPRTWCSSHDREPCSVQLS

SEQ ID NO: 31624 - protein, 390 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQIRYHTNNYASSSTSLPCQCSSTLMWSDHLER

SEQ ID NO: 31625 - protein, 388 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQVANAVSSCSNDGQKGQPISLSNEIIQTEA

SEQ ID NO: 31626 - protein, 374 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEEFWGN

SEQ ID NO: 31627 - protein, 365 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQEEFWGN

SEQ ID NO: 31628 - protein, 418 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQLICSLQNSQIQRATAHCGQVQTYRVLNREEMEVLVSSINVYTRISTVKTE

SEQ ID NO: 31629 - protein, 390 aa, Homo sapiens; identical to SEQ ID NO: 31624

SEQ ID NO: 31630 - protein, 390 aa, Homo sapiens; identical to SEQ ID NO: 31624

SEQ ID NO: 31631 - protein, 115 aa, Homo sapiens
MIPAKDMAKVMIVMLAICFLTKSDGKSVKKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 31632 - protein, 193 aa, Homo sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRIGAFGYMECSAKTKDGVREVFEMATRAALQARRGKKKSGCLVL

SEQ ID NO: 31633 - protein, 347 aa, Homo sapiens
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSGFFGHTVKKYSSFGDLVQVLGTPGKKGTSLNPLQFDNPAELYVEDTGDIYIVDGDGGLNNRLIKLSQDFMILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 31634 - protein, 1032 aa, Homo sapiens
MCNEETEIKEAQSYQNSPVSSATNQDAGYGSPFSESSDQLAHFKGSSSREEKEDPQCPDSVSYPQDSLAQIKAVYANLFSESCWSSLALDLKKSGSTTSTNDASQKESSAPTPTPPTCPVSTTGPTTSTPSTSCSSSTSHSSTTSTSSSSGYDWHQAALAKTLQQTSSYGLLPEPSLFSTVQLYRQNNKLYGSVFTGASKFRCKDCSAAYDTLVELTVHMNETGHYRDDNRDKDSEKTKRWSKPRKRSLMEMEGKEDAQKVLKCMYCGHSFESLQDLSVHMIKTKHYQKVPLKEPVPAITKLVPSTKKRALQDLAPPCSPEPAGMAAEVALSESAKDQKAANPYVTPNNRYGYQNGASYTWQFEARKAQILKCMECGSSHDTLQQLTAHMMVTGHFLKVTTSASKKGKQLVLDPVVEEKIQSIPLPPTTHTRLPASSIKKQPDSPAGSTTSEEKKEPEKEKPPVAGDAEKIKEESEDSLEKFEPSTLYPYLREEDLDDSPKGGLDILKSLENTVSTAISKAQNGAPSWGGYPSIHAAYQLPGTVKPLPAAVQSVQVQPSYAGGVKSLSSAEHNALLHSPGSLTPPPHKSNVSAMEELVEKVTGKVNIKKEERPPEKEKSSLAKAASPIAKENKDFPKTEEVSGKPQKKGPEAETGKAKKEGPLDVHTPNGTEPLKAKVTNGCNNLGIIMDHSPEPSFINPLSALQSIMNTHLGKVSKPVSPSLDPLAMLYKISNSMLDKPVYPATPVKQADAIDRYYYENSDQPIDLTKSKNKPLVSSVADSVASPLRESALMDISDMVKNLTGRLTPKSSTPSTVSEKSDADGSSFEEALDELSPVHKRKGRQSNWNPQHLLILQAQFASSLRETTEGKYIMSDLGPQERVHISKFTGLSMTTISHWLANVKYQLRRTGGTKFLKNLDTGHPVFFCNDCASQFRTASTYISHLETHLGFSLKDLSKLPLNQIQEQQNVSKVLTNKTLGPLGATEEDLGSTFQCKLCNRTFASKHAVKLHLSKTHGKSPEDHLIYVTELEKQ

SEQ ID NO: 31635 - protein, 719 aa, Homo sapiens
MGEKNGDAKTFWMELEDDGKVDFIFEQVQNVLQSLKQKIKDGSATNKEYIQAMILVNEATIINSSTSIKGASQKEVNAQSSDPMPVTQKEQENKSNAFPSTSCENSFPEDCTFLTTGNKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTMETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 31636 - protein, 160 aa, Homo sapiens
MDKLKKVLSGQDTEDRSGLSEVVEASSLSWSTRIKGFIACFAIGILCSLLGTVLLWVPRKGLHLFAVFYTFGNIASIGSTIFLMGPVKQLKRMFEPTRLIATIMVLLCFALTLCSAFWWHNKGLALIFCILQSLALTWYSLSFIPFARDAVKKCFAVCLA

SEQ ID NO: 31637 - protein, 714 aa, Homo sapiens
MTQMSQVQELFHEAAQQDALAQPQPWWKTQLFMWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQCVAGAMYITGFAESISDLLGLGNIWAVRGISVAVLLALLGINLAGVKWIIRLQLLLLFLLAVSTLDFVVGSFTHLDPEHGFIGYSPELLQNNTLPDYSPGESFFTVFGVFFPAATGVMAGFNMGGDLREPAASIPLGSLAAVGISWFLYIVFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLRSPQEQIILAPSLAKVDMEMTQLTQENADFATRDRYHHSSLVNREQLMPHY

SEQ ID NO: 31638 - protein, 532 aa, Homo sapiens
MEKSNETNGYLDSAQAGPAAGPGAPGTAAGRARRCAGFLRRQALVLLTVSGVLAGAGLGAALRGLSLSRTQVTYLAFPGEMLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 31639 - protein, 780 aa, Homo sapiens
MAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFGTSRHISVGPFPVVSLMVGSVVLSMAPDEHFLVSSSNGTVLNTTMIDTAARDTARVLIASALTLLVGIIQLIFGGLQIGFIVRYLADPLVGGFTTAAAFQVLVSQLKIVLNVSTKNYNGVLSIIYTLVEIFQNIGDTNLADFTAGLLTIVVCMAVKELNDRFRHKIPVPIPIEVIVTIIATAISYGANLEKNYNAGIVKSIPRGFLPPELPPVSLFSEMLAASFSIAVVAYAIAVSVGKVYATKYDYTIDGNQEFIAFGISNIFSGFFSCFVATTALSRTAVQESTGGKTQVAGIISAAIVMIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 31640 - protein, 643 aa, Homo sapiens
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 31641 - protein, 284 aa, Homo sapiens
MKRDKKRNKIPIDNYPIQTLVNMSLNPSRPSSSELVELHVFYVPEGSWNYKLNTISTEVVNKFISAGFLRVSPQLTLRALRERLGEFLGEDAIAEKFLFLKCIGNNLAVVKEKQESELKLKSFAPPYAPQPELYLLPVMDHLGNVYSPSTVILDERQTNNGVNEADGTIHRPISVTLFKEELGRDPSLLENTLKELPNKNQEEAGGKATAEKSQIAKNQIGNSELPGSLEDSNNDCFGTKKSVFGKMKMIQLSVEDRTIRQLKKSTSPYQITLHFLVNLFFLQE

SEQ ID NO: 31642 - protein, 473 aa, Homo sapiens
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 31643 - protein, 143 aa, Homo sapiens
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFE

SEQ ID NO: 31644 - protein, 2768 aa, Homo sapiens
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 31645 - protein, 229 aa, Homo sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQILLRAFEARDRNIQESNFDRVNFWSMVNLVVMVVVSAIQVYMLKSLFEDKRKSRT

SEQ ID NO: 31646 - protein, 352 aa, Homo sapiens
MALPFRKDLEKYKDLDEDELLGNLSETELKQLETVLDDLDPENALLPAGFRQKNQTSKSTTGPFDREHLLSYLEKEALEHKDREDYVPYTGEKKGKIFIPKQKPVQTFTEEKVSLDPELEEALTSASDTELCDLAAILGMHNLITNTKFCNIMGSSNGVDQEHFSNVVKGEKILPVFDEPPNPTNVEESLKRTKENDAHLVEVNLNNIKNIPIPTLKDFAKALETNTHVKCFSLAATRSNDPVATAFAEMLKVNKTLKSLNVESNFITGVGILALIDALRDNETLAELKIDNQRQQLGTAVELEMAKMLEENTNILKFGYQFTQQGPRTRAANAITKNNDLVRKRRVEGDHQ

SEQ ID NO: 31647 - protein, 933 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 31648 - protein, 876 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 31649 - protein, 929 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWRVLGWKAGILTGCREPSEGKVAGHCRTASCSQNHRTTLFQTQANRKSAGRLFSQHG

SEQ ID NO: 31650 - protein, 889 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 31651 - protein, 760 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 31652 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIENSHLTPKKQGQISEEYMQTVL

SEQ ID NO: 31653 - protein, 253 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLLPLGRKSLSFETQKAPRSSMPS

SEQ ID NO: 31654 - protein, 241 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 31655 - protein, 266 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLVRGELEQQGFIHTKGCVGQFEKWLQDNLIVVAGVFMGIALLQIFGICLAQNLEQME

SEQ ID NO: 31656 - protein, 332 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLVRGELEQQGFIHTKGCVGQFEKWLQDNLIVVAGVFMGIALLQIFGICLAQNLVSDIKAVKANWSKWNDDFENHWLTPTISEVLSTAGPQQNSLTGAPGPAPPSRHVFFGLGGLYPEPTFKNW

SEQ ID NO: 31657 - protein, 329 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANWSKWNDDFENHWLTPTISEVLSTAGPQQNSLTGAPGPAPPSRHVFFGLGGLYPEPTFKNW

SEQ ID NO: 31658 - protein, 230 aa, Homo sapiens
MEGQRWLPLEANPEVTNQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELDGRKPFPINHGETSDETLLEDAIEVCKKFMERDPDELRFNAIALSAA

SEQ ID NO: 31659 - protein, 941 aa, Homo sapiens
MAAYLQWRRFVFFDKELVKEPLSNDGAAPGATPASGSAASKFLCLPPGITVCDSGRGSLVFGDMEGQIWFLPRSLQLTGFQAYKLRVTHLYQLKQHNILASVGEDEEGINPLVKIWNLEKRDGGNPLCTRIFPAIPGTEPTVVSCLTVHENLNFMAIGFTDGSVTLNKGDITRDRHSKTQILHKGNYPVTGLAFRQAGKTTHLFVVTTENVQSYIVSGKDYPRVELDTHGCGLRCSALSDPSQDLQFIVAGDECVYLYQPDERGPCFAFEGHKLIAHWFRGYLIIVSRDRKVSPKSEFTSRDSQSSDKQILNIYDLCNKFIAYSTVFEDVVDVLAEWGSLYVLTRDGRVHALQEKDTQTKLEMLFKKNLFEMAINLAKSQHLDSDGLAQIFMQYGDHLYSKGNHDGAVQQYIRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIKNYQEALRYIGKLPFEQAESNMKRYGKILMHHIPEQTTQLLKGLCTDYRPSLEGRSDREAPGCRANSEEFIPIFANNPRELKAFLEHMSEVQPDSPQGIYDTLLELRLQNWAHEKDPQVKEKLHAEAISLLKSGRFCDVFDKALVLCQMHDFQDGVLYLYEQGKLFQQIMHYHMQHEQYRQVISVCERHGEQDPSLWEQALSYFARKEEDCKEYVAAVLKHIENKNLMPPLLVVQTLAHNSTATLSVIRDYLVQKLQKQSQQIAQDELRVRRYREETTRIRQEIQELKASPKIFQKTKCSICNSALELPSVHFLCGHSFHQHCFESYSESDADCPTCLPENRKVMDMIRAQEQKRDLHDQFQHQLKCSNDSFSVIADYFGRGVFNKLTLLTDPPTARLTSSLEAGLQRDLLMHSRRGT

SEQ ID NO: 31660 - protein, 723 aa, Homo sapiens
MAAAATMAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 31661 - protein, 306 aa, Homo sapiens
MAAVDDLQFEEFGNAATSLTANPDATTVNIEDPGETPKHQPGSPRGSGREEDDELLGNDDSDKTELLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 31662 - protein, 559 aa, Homo sapiens
MSATSVDTQRTKGQDNKVQNGSLHQKDTVHDNDFEPYLTGQSNQSNSYPSMSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPGMNSLEQGMVGLKIGDVSSSAVKTVGSVVSSVALTGVLSGNGGTNVNMPVSKPTSWAAIASKPAKPQPKMKTKSGPVMGGGLPPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEFEWNLKSGRVFIIKSYSEDDIHRSIKYSIWCSTEHGNKRLDSAFRCMSSKGPVYLLFSVNGSGHFCGVAEMKSPVDYGTSAGVWSQDKWKGKFDVQWIFVKDVPNNQLRHIRLENNDNKPVTNSRDTQEVPLEKAKQVLKIISSYKHTTSIFDDFAHYEKRQEEEEVVRKERQSRNKQ

SEQ ID NO: 31663 - protein, 739 aa, Homo sapiens
MGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 31664 - protein, 796 aa, Homo sapiens
MEEEASRSAAATNPGSRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 31665 - protein, 750 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 31666 - protein, 467 aa, Homo sapiens
MNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 31667 - protein, 684 aa, Homo sapiens
MKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 31668 - protein, 673 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 31669 - protein, 673 aa, Homo sapiens; identical to SEQ ID NO: 31668

SEQ ID NO: 31670 - protein, 680 aa, Homo sapiens
MKMKKFQIPVSFQDLTVNFTQEEWQQLDPAQRLLYRDVMLENYSNLVSVGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRSHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 31671 - protein, 642 aa, Homo sapiens
MLENYSNLVSVGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRSHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 31672 - protein, 462 aa, Homo sapiens
MLCDEEAQKRKAKESGMALPQGRLTFMDVAIEFSQEEWKSLDPGQRALYRDVMLENYRNLVFLGICLPDLSIISMLKQRREPLILQSQVKIVKNTDGRECVRSVNTGRSCVLGSNAENKPIKNQLGLTLESHLSELQLFQAGRKIYRSNQVEKFTNHRSSVSPLQKISSSFTTHIFNKYRNDLIDFPLLPQEEKAYIRGKSYEYECSEDGEVFRVPASLTNHQVIHTAEKPYKCTECGKVFSRNSHLVEHWRIHTGQKPYKCSECDKVFNRNSNLARHQRIHTGEKPHKCNECGKAFRECSGLTTHLVIHTGEKPYKCNECGKNFRHKFSLTNHQRSHTAEKPYKCNECGKVFSLLSYLARHQIIHSTEKPYKCNECGRAFHKRPGLMAHLLIHTGEKPYKCNECDKVFGRKLYLTNHQRIHTGERPYKCNACGKVFNQNPHLSRHRKIHAGENSLRTLQME

SEQ ID NO: 31673 - DNA, 17 bp, Homo sapiens
gatcagcaaacagtggt

SEQ ID NO: 31674 - DNA, 17 bp, Homo sapiens
gatccctctctgggtct

SEQ ID NO: 31675 - DNA, 17 bp, Homo sapiens
gatcctcattgagccac

SEQ ID NO: 31676 - DNA, 17 bp, Homo sapiens
gatccctgtaccaggaa

SEQ ID NO: 31677 - DNA, 17 bp, Homo sapiens
gatcgccttcgacgact

SEQ ID NO: 31678 - DNA, 17 bp, Homo sapiens
gatctagggaaaaagtg

SEQ ID NO: 31679 - DNA, 17 bp, Homo sapiens
gatcaattgcatctacc

SEQ ID NO: 31680 - DNA, 17 bp, Homo sapiens
gatcatctttccttgcc

SEQ ID NO: 31681 - DNA, 17 bp, Homo sapiens
gatctttttggtagttg

SEQ ID NO: 31682 - DNA, 17 bp, Homo sapiens
gatctttctttcatgag

SEQ ID NO: 31683 - DNA, 17 bp, Homo sapiens
gatcaaaaaagacaggc

SEQ ID NO: 31684 - DNA, 17 bp, Homo sapiens
gatcccagcctgaggag

SEQ ID NO: 31685 - DNA, 17 bp, Homo sapiens
gatctggggcaagtgtt

SEQ ID NO: 31686 - DNA, 17 bp, Homo sapiens
gatctccatttaagccc

SEQ ID NO: 31687 - DNA, 17 bp, Homo sapiens
gatctttttcccctctt

SEQ ID NO: 31688 - DNA, 17 bp, Homo sapiens
gatctcagaagctcatc

SEQ ID NO: 31689 - DNA, 17 bp, Homo sapiens
gatcctcttgctgttct

SEQ ID NO: 31690 - DNA, 17 bp, Homo sapiens
gatctgacttgtaagca

SEQ ID NO: 31691 - DNA, 17 bp, Homo sapiens
gatccgtctgttcctaa

SEQ ID NO: 31692 - DNA, 17 bp, Homo sapiens
gatcatttgaggaataa

SEQ ID NO: 31693 - DNA, 17 bp, Homo sapiens
gatccaaaaactttcca

SEQ ID NO: 31694 - DNA, 17 bp, Homo sapiens
gatcgtctggccaaact

SEQ ID NO: 31695 - DNA, 17 bp, Homo sapiens
gatccgctcacaggagg

SEQ ID NO: 31696 - DNA, 17 bp, Homo sapiens
gatcctgcagctcatcc

SEQ ID NO: 31697 - DNA, 17 bp, Homo sapiens
gatccatttcctcacct

SEQ ID NO: 31698 - DNA, 17 bp, Homo sapiens
gatccaataattctatt

SEQ ID NO: 31699 - DNA, 17 bp, Homo sapiens
gatctcatctttcgggc

SEQ ID NO: 31700 - DNA, 17 bp, Homo sapiens
gatcagcaggttgaggc

SEQ ID NO: 31701 - DNA, 17 bp, Homo sapiens
gatcagagacagcttca

SEQ ID NO: 31702 - DNA, 17 bp, Homo sapiens
gatcaaaaaatggagcc

SEQ ID NO: 31703 - DNA, 17 bp, Homo sapiens
gatctccctggttgctt

SEQ ID NO: 31704 - DNA, 17 bp, Homo sapiens
gatcttcaatcaaagcc

SEQ ID NO: 31705 - DNA, 17 bp, Homo sapiens
gatcaaaattcagttgt

SEQ ID NO: 31706 - DNA, 17 bp, Homo sapiens
gatcatctgtaatctga

SEQ ID NO: 31707 - DNA, 17 bp, Homo sapiens
gatctcagtatattaaa

SEQ ID NO: 31708 - DNA, 17 bp, Homo sapiens
gatccaagttggaagga

SEQ ID NO: 31709 - DNA, 17 bp, Homo sapiens
gatcaaacaagacagca

SEQ ID NO: 31710 - DNA, 17 bp, Homo sapiens
gatcatgccacaacatt

SEQ ID NO: 31711 - DNA, 17 bp, Homo sapiens
gatcctgctaataaaca

SEQ ID NO: 31712 - DNA, 17 bp, Homo sapiens
gatctattctctggcta

SEQ ID NO: 31713 - DNA, 17 bp, Homo sapiens
gatctttctagccctga

SEQ ID NO: 31714 - DNA, 17 bp, Homo sapiens
gatcctccattattttg

SEQ ID NO: 31715 - DNA, 17 bp, Homo sapiens
gatcatttctttcctat

SEQ ID NO: 31716 - DNA, 17 bp, Homo sapiens
gatcaggtaatttcact

SEQ ID NO: 31717 - DNA, 17 bp, Homo sapiens
gatctgcatcctgaagt

SEQ ID NO: 31718 - DNA, 17 bp, Homo sapiens
gatctggactttggcct

SEQ ID NO: 31719 - DNA, 17 bp, Homo sapiens
gatctcattttaagaaa

SEQ ID NO: 31720 - DNA, 17 bp, Homo sapiens
gatccttattattctaa

SEQ ID NO: 31721 - DNA, 17 bp, Homo sapiens
gatctgcagtccaaatc

SEQ ID NO: 31722 - DNA, 17 bp, Homo sapiens
gatctgttgtctattca

SEQ ID NO: 31723 - DNA, 17 bp, Homo sapiens
gatcggtccactgagat

SEQ ID NO: 31724 - DNA, 17 bp, Homo sapiens
gatcctgagcagtgcca

SEQ ID NO: 31725 - DNA, 17 bp, Homo sapiens
gatccggttgggatgaa

SEQ ID NO: 31726 - DNA, 17 bp, Homo sapiens
gatccaacatatactat

SEQ ID NO: 31727 - DNA, 17 bp, Homo sapiens
gatcctggggtttgtca

SEQ ID NO: 31728 - DNA, 17 bp, Homo sapiens
gatcttcctttttcctc

SEQ ID NO: 31729 - DNA, 17 bp, Homo sapiens
gatcctgaaagtcactt

SEQ ID NO: 31730 - DNA, 17 bp, Homo sapiens
gatctgagggagaacaa

SEQ ID NO: 31731 - DNA, 17 bp, Homo sapiens
gatcatagtcctgagag

SEQ ID NO: 31732 - DNA, 17 bp, Homo sapiens
gatctattgcatagtgt

SEQ ID NO: 31733 - DNA, 17 bp, Homo sapiens
gatctgtggacaataac

SEQ ID NO: 31734 - DNA, 17 bp, Homo sapiens
gatcatgaagaggatgc

SEQ ID NO: 31735 - DNA, 17 bp, Homo sapiens
gatcagacactggtgct

SEQ ID NO: 31736 - DNA, 17 bp, Homo sapiens
gatcagtcctgtccaat

SEQ ID NO: 31737 - DNA, 17 bp, Homo sapiens
gatcagaccaggaggga

SEQ ID NO: 31738 - DNA, 17 bp, Homo sapiens
gatctaccctgagacca

SEQ ID NO: 31739 - DNA, 17 bp, Homo sapiens
gatctgaaccacctaca

SEQ ID NO: 31740 - DNA, 17 bp, Homo sapiens
gatcagcaatccttaaa

SEQ ID NO: 31741 - DNA, 17 bp, Homo sapiens
gatccacgtgaaaaaaa

SEQ ID NO: 31742 - DNA, 17 bp, Homo sapiens
gatctttattattaaac

SEQ ID NO: 31743 - DNA, 17 bp, Homo sapiens
gatcatccttcgatacc

SEQ ID NO: 31744 - DNA, 17 bp, Homo sapiens
gatccatagctttcatc

SEQ ID NO: 31745 - DNA, 17 bp, Homo sapiens
gatcaaacacgtcactc

SEQ ID NO: 31746 - DNA, 17 bp, Homo sapiens
gatccagagtctcatgt

SEQ ID NO: 31747 - DNA, 17 bp, Homo sapiens
gatccccaacctggctc

SEQ ID NO: 31748 - DNA, 17 bp, Homo sapiens
gatccccctgggccaag

SEQ ID NO: 31749 - DNA, 17 bp, Homo sapiens
gatcacttgaatccaga

SEQ ID NO: 31750 - DNA, 17 bp, Homo sapiens
gatcgtcggttctgtga

SEQ ID NO: 31751 - DNA, 17 bp, Homo sapiens
gatctcagcaggtaaga

SEQ ID NO: 31752 - DNA, 17 bp, Homo sapiens
gatcctttgcctgtcag

SEQ ID NO: 31753 - DNA, 17 bp, Homo sapiens
gatcattttaccatgga

SEQ ID NO: 31754 - DNA, 17 bp, Homo sapiens
gatcttaggggaaagcc

SEQ ID NO: 31755 - DNA, 17 bp, Homo sapiens
gatcttatcaagagatg

SEQ ID NO: 31756 - DNA, 17 bp, Homo sapiens
gatcttatgtttatttt

SEQ ID NO: 31757 - DNA, 17 bp, Homo sapiens
gatcagcctcagctttg

SEQ ID NO: 31758 - DNA, 17 bp, Homo sapiens
gatcttttttaaagctg

SEQ ID NO: 31759 - DNA, 17 bp, Homo sapiens
gatcaatgctgagctga

SEQ ID NO: 31760 - DNA, 17 bp, Homo sapiens
gatctcactgaacagat

SEQ ID NO: 31761 - DNA, 17 bp, Homo sapiens
gatcaagcctctgttga

SEQ ID NO: 31762 - DNA, 17 bp, Homo sapiens
gatcatgtcctgatgcc

SEQ ID NO: 31763 - DNA, 17 bp, Homo sapiens
gatcttgaagggtcctt

SEQ ID NO: 31764 - DNA, 17 bp, Homo sapiens
gatcctgctctgagggg

SEQ ID NO: 31765 - DNA, 17 bp, Homo sapiens
gatctgcagccactgca

SEQ ID NO: 31766 - DNA, 17 bp, Homo sapiens
gatctgtcaatacaaga

SEQ ID NO: 31767 - DNA, 17 bp, Homo sapiens
gatctgttgcctaaact

SEQ ID NO: 31768 - DNA, 17 bp, Homo sapiens
gatctgtagtagctcag

SEQ ID NO: 31769 - DNA, 17 bp, Homo sapiens
gatcatgaatgtccgaa

SEQ ID NO: 31770 - DNA, 17 bp, Homo sapiens
gatcccttgcattcaca

SEQ ID NO: 31771 - DNA, 17 bp, Homo sapiens
gatcattttgtaaaaat

SEQ ID NO: 31772 - DNA, 17 bp, Homo sapiens
gatctaatgtttctaaa

SEQ ID NO: 31773 - DNA, 17 bp, Homo sapiens
gatctggactggaggag

SEQ ID NO: 31774 - DNA, 17 bp, Homo sapiens
gatctcctggtttgctt

SEQ ID NO: 31775 - DNA, 17 bp, Homo sapiens
gatccctttctgaagtg

SEQ ID NO: 31776 - DNA, 17 bp, Homo sapiens
gatcattgttagtctta

SEQ ID NO: 31777 - DNA, 17 bp, Homo sapiens
gatcagtaaacatttat

SEQ ID NO: 31778 - DNA, 17 bp, Homo sapiens
gatcatgaaaaaacttt

SEQ ID NO: 31779 - DNA, 17 bp, Homo sapiens
gatcttaaggtgttggg

SEQ ID NO: 31780 - DNA, 17 bp, Homo sapiens
gatcatatgtgggttca

SEQ ID NO: 31781 - DNA, 17 bp, Homo sapiens
gatctctttctccctta

SEQ ID NO: 31782 - DNA, 17 bp, Homo sapiens
gatctggttcagtgaag

SEQ ID NO: 31783 - DNA, 17 bp, Homo sapiens
gatcataagtctaaata

SEQ ID NO: 31784 - DNA, 17 bp, Homo sapiens
gatcattacatttttgt

SEQ ID NO: 31785 - DNA, 17 bp, Homo sapiens
gatcttcgttcaggtat

SEQ ID NO: 31786 - DNA, 17 bp, Homo sapiens
gatcataatcttcctgc

SEQ ID NO: 31787 - DNA, 17 bp, Homo sapiens
gatcaccaaaagaactg

SEQ ID NO: 31788 - DNA, 17 bp, Homo sapiens
gatcaaaaattctgaaa

SEQ ID NO: 31789 - DNA, 17 bp, Homo sapiens
gatctgaatgaaatgcc

SEQ ID NO: 31790 - DNA, 17 bp, Homo sapiens
gatcttgctggaaaaag

SEQ ID NO: 31791 - DNA, 17 bp, Homo sapiens
gatcctcaggcgctgtt

SEQ ID NO: 31792 - DNA, 17 bp, Homo sapiens
gatctgtcttcccaccc

SEQ ID NO: 31793 - DNA, 17 bp, Homo sapiens
gatcaaaggaggtgttg

SEQ ID NO: 31794 - DNA, 17 bp, Homo sapiens
gatcagcggtccatctg

SEQ ID NO: 31795 - DNA, 17 bp, Homo sapiens
gatcatctaatctgcaa

SEQ ID NO: 31796 - DNA, 17 bp, Homo sapiens
gatcattagaaacataa

SEQ ID NO: 31797 - DNA, 17 bp, Homo sapiens
gatcccatgtaccgtcc

SEQ ID NO: 31798 - DNA, 17 bp, Homo sapiens
gatcgcaccgctgcaca

SEQ ID NO: 31799 - DNA, 17 bp, Homo sapiens
gatctctggggcagccc

SEQ ID NO: 31800 - DNA, 17 bp, Homo sapiens
gatctgcttgccgtgaa

SEQ ID NO: 31801 - DNA, 17 bp, Homo sapiens
gatccatatgggacttg

SEQ ID NO: 31802 - DNA, 17 bp, Homo sapiens
gatcgcgccgctgtact

SEQ ID NO: 31803 - DNA, 17 bp, Homo sapiens
gatcaccatgtaaggtc

SEQ ID NO: 31804 - DNA, 17 bp, Homo sapiens
gatctgtgtaaaatctg

SEQ ID NO: 31805 - DNA, 17 bp, Homo sapiens
gatcagttctgacatta

SEQ ID NO: 31806 - DNA, 17 bp, Homo sapiens
gatcctaaaaatgatga

SEQ ID NO: 31807 - DNA, 17 bp, Homo sapiens
gatcctaagcatttcca

SEQ ID NO: 31808 - DNA, 17 bp, Homo sapiens
gatctgtcaaataaatt

SEQ ID NO: 31809 - DNA, 17 bp, Homo sapiens
gatcttccaataatcaa

SEQ ID NO: 31810 - DNA, 17 bp, Homo sapiens
gatcaatgcatctacga

SEQ ID NO: 31811 - DNA, 17 bp, Homo sapiens
gatcctcttagaaggaa

SEQ ID NO: 31812 - DNA, 17 bp, Homo sapiens
gatctcttggttctttt

SEQ ID NO: 31813 - DNA, 17 bp, Homo sapiens
gatcctctgcaacactg

SEQ ID NO: 31814 - DNA, 17 bp, Homo sapiens
gatcatgctatgttgcc

SEQ ID NO: 31815 - DNA, 17 bp, Homo sapiens
gatcaacaaccactgaa

SEQ ID NO: 31816 - DNA, 17 bp, Homo sapiens
gatccagccgtcaactc

SEQ ID NO: 31817 - DNA, 17 bp, Homo sapiens
gatccctctgaagcctg

SEQ ID NO: 31818 - DNA, 17 bp, Homo sapiens
gatctcctaagcctcca

SEQ ID NO: 31819 - DNA, 17 bp, Homo sapiens
gatctgatgaagtggga

SEQ ID NO: 31820 - DNA, 17 bp, Homo sapiens
gatctgctcattgggag

SEQ ID NO: 31821 - DNA, 17 bp, Homo sapiens
gatcttactgagtggct

SEQ ID NO: 31822 - DNA, 17 bp, Homo sapiens
gatctacagggaaaaca

SEQ ID NO: 31823 - DNA, 17 bp, Homo sapiens
gatcgtacctctgccct

SEQ ID NO: 31824 - DNA, 17 bp, Homo sapiens
gatcctccagtctgaaa

SEQ ID NO: 31825 - DNA, 17 bp, Homo sapiens
gatctaaaatctcctac

SEQ ID NO: 31826 - DNA, 17 bp, Homo sapiens
gatctcacccacgaatg

SEQ ID NO: 31827 - DNA, 17 bp, Homo sapiens
gatcagtatgcattctg

SEQ ID NO: 31828 - DNA, 17 bp, Homo sapiens
gatcccagaggaaataa

SEQ ID NO: 31829 - DNA, 17 bp, Homo sapiens
gatccacaactagatgg

SEQ ID NO: 31830 - DNA, 17 bp, Homo sapiens
gatcttcagaaaggatg

SEQ ID NO: 31831 - DNA, 17 bp, Homo sapiens
gatcatcttttctactc

SEQ ID NO: 31832 - DNA, 17 bp, Homo sapiens
gatcaggaacctccaaa

SEQ ID NO: 31833 - DNA, 17 bp, Homo sapiens
gatcacagtggtctcca

SEQ ID NO: 31834 - DNA, 17 bp, Homo sapiens
gatctgacctgcccaac

SEQ ID NO: 31835 - DNA, 17 bp, Homo sapiens
gatcaatgttataataa

SEQ ID NO: 31836 - DNA, 17 bp, Homo sapiens
gatctataaatttttat

SEQ ID NO: 31837 - DNA, 17 bp, Homo sapiens
gatctacactgctagtg

SEQ ID NO: 31838 - DNA, 17 bp, Homo sapiens
gatccactctcagcctc

SEQ ID NO: 31839 - DNA, 17 bp, Homo sapiens
gatcagggttttgaaga

SEQ ID NO: 31840 - DNA, 17 bp, Homo sapiens
gatcatccatgggtgaa

SEQ ID NO: 31841 - DNA, 17 bp, Homo sapiens
gatcccgcccctacccc

SEQ ID NO: 31842 - DNA, 17 bp, Homo sapiens
gatccagccacatcagt

SEQ ID NO: 31843 - DNA, 17 bp, Homo sapiens
gatctactcgtcagctc

SEQ ID NO: 31844 - DNA, 17 bp, Homo sapiens
gatctgaccttcatttc

SEQ ID NO: 31845 - DNA, 17 bp, Homo sapiens
gatcttttagaggtttt

SEQ ID NO: 31846 - DNA, 17 bp, Homo sapiens
gatcctgctttttcctg

SEQ ID NO: 31847 - DNA, 1701 bp, Homo sapiens
ccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaaaaaaaaaaa

SEQ ID NO: 31848 - DNA, 917 bp, Homo sapiens
tgatgccctatgtattctccttcaaaatgcctcaagagcaaggacagatgtttcaatactatccagtttacatggtcctaccctgggaacaacctcagcaaacagttccaaggtcacctcaacaaacaagacagcaacagtatgaggagcagataccattctatgctcaatttggatacattccacaactagcagaacctgctatatcaggaggacagcagcaactagcttttgatccccaactaggcacagctcctgaaattgctgtgatgtcaacaggagaagagataccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggacaagactgacagcctaagggaaccataagaagttgccctgatcattcagacattttgggaaaaagatgtggccatgccttggatataattttaggctattagcttcctcaatactagtatcagttctttggaatacatgaaatatcttgactcttctcctaaatttgtttttacttatacatgttattaaactctttaaatatgtcatagaaaataatacaatcatgtaatgagtcttgtcttacaaaattatatgtctcttcaaatatcctatcattgtataatatggaatataataacacagaataaagctagtatcattaaatcaattggataattgcattagtaaatgatgcctctgcaaaatggtagtacccatgaagatatgtatattgtcattggatgtatgatgagtgttgtgattggaactgatgaagtaaaataagtatctaaaaaaaaaaaaaaaaaaaaaaaaaaaaaa

SEQ ID NO: 31849 - DNA, 1734 bp, Homo sapiens
ggtctgaggcctctgcctaaagacaaagcctgtgctggggtgtgcaggatataaggttggacttccagacccactgcccgggagaggagaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccagctctcctgtctcccagtgaagacttggatggcagccatcagggaaggctgggtcccagctgggagtatgggtgtgagctctatagaccatccctctctgcaatcaataaacacttgcctgtgatgcctgcaaaaaaa

SEQ ID NO: 31850 - DNA, 6920 bp, Homo sapiens
gagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcctt

SEQ ID NO: 31851 - DNA, 6996 bp, Homo sapiens
gagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagggtctcaccctgtcactcaggctggagcacagtggtgtgatcacagctcactgcagcctcgacctcctggactcagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcctt

SEQ ID NO: 31852 - DNA, 2484 bp, Homo sapiens
attcctcgttagggcaggcgcggccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaaaaaaaaaaaaaaaaaa

SEQ ID NO: 31853 - DNA, 2384 bp, Homo sapiens
attcctcgttagggcaggcgcggccccttcggctccgagctgaccctgatcagggccgagttgtctcggcggcgctgccgaggcctccacccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaaaaaaaaaaaaaaaaaa

SEQ ID NO: 31854 - DNA, 2974 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattgctgattctttaaatgtcttgtttcccagatttcaggaaactttttttcttttaagctatccactcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaaaaa

SEQ ID NO: 31855 - DNA, 6044 bp, Homo sapiens
gcgcgggagacagttcgctccgactgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactg

SEQ ID NO: 31856 - DNA, 7445 bp, Homo sapiens
gggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaagatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactg

SEQ ID NO: 31857 - DNA, 3995 bp, Homo sapiens
ggatccgcgggacagatgaggaaggggcttaagtcactgcagccagagggatggaggtggactgatgggagggcttctccggtggggttagaagggaaaagtagggaaagagaagtgtaaggtagatggcagaggcagagacatggaaagacagactctagggttcctgatgatatctatctcggccaacacaaaagggagggtacagtggtgggggcacccaagctagggtgtgagtaccctaagtgtattcttctgagatgtaggccattcactaactcttggaacagctacagtttcacagtaggaagacccccccagattcactgcccctcccttagtaaagcctctgagaccttcctgaacattcccttctgtctttgccctctgttccttccagagactatgtgcccaggcagatggattcctcccgggcctgagaggaactgcaggaattctcctgcctcttacccgtaaaaccccaacttctctagccctagggcaggaagtcccaaacaatttctacccctttttctgcaattctcattggggtgagaggaggcccaggaggagagagagctgggctcagcttctttttgagctgctggagccctctgtgaggaggccctctttgctggcttctcaggagagtgtggctaggttctgcctgcctatgggaagagggggccagggtgtgtggagcaagatggtgcggtgctggtgccttgggacctgggggaatgggacagctggtcggctcagagacggcctactttactcacagctggaatttagtggggagaagcagctcaactccaatcctggaggattagggagattaaagtgagagaagagagagatgtcccagagaccaagagctcccaggtcagccctctggctcctggcacccccactgctgcggtgggcacccccactcctcacagtgctgcatagcgacctcttccaggccttgctggacatcctggactattatgaggcttccctctcagagagtcagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccttgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgcctcatcgtaattccccatgttaccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggctttttttttttttttcctgggaatttttttggggaaaagggagggatgggtctagggagtgggaaatgcgggagggagggtggggcaggggtcgggggtcgggtgtccgggagccagggaagactggaaatgctgccgccttctgcaatttatttatttttttcttttgagagagtgaaaggaagagacagatacttgaaaaaaaaaaaaaaaaaaaa

SEQ ID NO: 31858 - DNA, 3534 bp, Homo sapiens
tttagaagaccaggtggaactctgtgctaagaagcttgaaagagcctcacaattaattggaggactgggtggagaaaaatcaagatgggcccaagctgcagatgaccttcagataacatatgaaaatttaactggcgatgtcttagtatcagcaggagtaatagcttaccttggtgctttcacttctggctttcgacaaacatgtacaaaagattggagcatgttgtgcaagaagaaaaaaatcccgtgttcagaggagttcttgttgagtaaaaccctgggtgatccagtaaaaattagagcttggaatattgctggtttaccaacagatacattttccatagataacggagtgatcgttaacaactgtaggcgttggcctttaatgattgacccccagggtcaagccaataagtggatcaaaaactctgaaagagaaaatcagcttagtgttattaagctatcagattcagactatatgagaacattggaaaactgtattcagtttggaactccacttctattagaaaatgttggtgaagaactggatccatctttggagcctttactactcagacaaacttttaaacaaggtggcattgattgcatcagacttggtgaggtcattattgagtattcctttgatttcaaattttatatcaccacaaaactgagaaacccgcactatatgccagaactggctacaaaagtgtctttgctcaatttcatgataactccagaaggacttgaagatcaattactaggtattgttgttgcaaaggagagaccagaattagaagaggaacgaaatgccctgattcttcagtctgcagctaacaagaaacagctgaaagacatagagaaaaaaattttagaaacattatcatcatcagaaggaaacattttagaagatgaaagtgcaattaaagtcttagactctgccaaaatgatgtccaatgaaataacaaagaaacagcagattgcagaaaaaacagaactcaaaatagcagagtctcgagaaggctatagacccatcgccaaacactcgtcagtgttattctttagcattgcagacctggctaatattgatcccatgtatcagtactctctcacgtggtttgtgaacctttatatcaactctattcatgacagtaacaaatccaagattttggaaaagcgcctacgatatttaaatgaccacttcacatacaacttatattgtaatatatgccgatcactatttgagaaggacaagctgttattttcctttttattatgtgccaatcttcttctggcaaggaaagagattgaataccaggaactgatgtttcttttaactggaggagtaagtcttaaaagtgctgagaaaaatcctgatccaacttggctacaggacaaaagctgggaggaaatctgtcgggcaagtgaatttcctgccttcagaggactcaggcaacatttttgtgaacatatatatgaatggcgagaaatctatgacagtaaagagccacataatgctaaatttccagcaccaatggataagaacctaaatgaactacagaaaataataattcttcggtgtttaagacctgataagataaccccagctataacaaactatgtaactgacaaactagggaaaaagtttgtagagcctccaccatttgatttgacaaagagttacttggattcaaattgcaccattcccttaatttttgttctatctccaggagcagatcctatggccagcctgctgaaatttgcaaatgataaatctatgtctggaaataagtttcaagctatttcactgggacagggacaaggaccgattgcagcaaaaatgattaaagcagcaattgaagaaggaacttgggtgtgcctacagaattgccatcttgcagtgtcctggatgcccatgttggaaaaaatatgtgaagattttacctctgaaacctgtaactcatcctttaggctttggctgacaagctatccatcttcaaaattcccagtaacaattctacagaatggagtaaaaatgactaatgaacctcccacgggtcttcggctgaatctccttcaatcatatctcactgatccagtttctgatcctgagtttttcaagggatgccgtggaaaggaactggcctgggagaagttactgtttggagtttgtttttttcatgcccttgtgcaagagagaaagaaatttggtcctcttggttggaatattccatatggatttaatgaatctgacttgcgcatcagtatccgacaactgcagttatttatcaatgaatatgatacaattccatttgaagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagaaacttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaatttaattataactatacgtaacactctacgggaccttgaaaaagctattaagggtgtggttgtgatggattctgcattggaggcactctccggtagcttacttgttggaaaggttccagaaatatgggccaaacgttcatacccaagccttaagcccctgggaagttacatcacagatttcctagcccggttgaactttttacaggactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagttt

SEQ ID NO: 31859 - DNA, 1897 bp, Homo sapiens
gtgggcggccccatcgcctagcaaccgggtggcagcgtcccttgagcccaggccacacagctgcacccagccctgcccggctcctcccaggcctgcaggacccctggggccctgtccttattccccagcaccgggacagccaaagctctggtcacaatgaacatcgtcttctccagggacagccaggtgagggtgatggagaataccgtggccaacaccgagaagtactttgggcagttctgctcgctgctggccgcctacacgcgcaagacggcccggctgcgggacaaggcggaccagctggtcaagcagctcatcgactttgccaactccgagaaccccgagctgcgggccaccatgaggggcttcgctgaggacctggccaaagtgcaggattaccggcaggcccaggtcgagaggctggagaccaaggtggtcaaccccctgaagctctacggggcacagatcaagcagacacgggctgagatcaagaaattcaaacatgtccaaaatcatgagatcaaacaactggaaaaactggagaaactgaggcagaagtcaccctcggatcagcaaatgatctcccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagggaactctgcaggtccagctgagtagggcaaatgaagaccctgaacatcctcatgccaatcatggcaggtttagtctctgtgagtgggtagttaaggggcagccagcccactgtgtgtgtgggcagggtgggcatctcatgcttccaggacattctctctaacgacgtagggtaagtgcaatcccaagccgtttaaaataatcccagactgcctggaggctttgttcttattttctgattcttttttctttgtctttgttggattgtgttaattcaaagaccttgtcttcaagctctgaatttccttcttctacttgttcaattctgttgctgagactttccagagcattttgcatttctgtgagtgtatccaatgtttcctgaagttttgattgtttttctttatgctatctatttcttggtccgagcccactgctcctggcggtgtgaccttgggaaagtctcctagcctctctgtgccttagagtcctcgcctgcagagtggcttagaacagtaacctccgtgtagggctgtgctgagtatcagatgaacagatctatacgaagcacagaaaacccggcctgttgcgcaacaaacacttgagacttgttgctgccattatcattactgatgttgctgtcgttttattattattattatttagagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgccctgtgactctc

SEQ ID NO: 31860 - DNA, 2583 bp, Homo sapiens
gttcccacttcctcccgccccaggaaacctgccatggcctcctggtgagctgtcctcatccactgctcgctgcctctccagatcttcagttgcttcaggccactttgaatgtatatgagccggtcgtaggggatatcgatggcttagcttgggctcagaggcctgaaaatcgcccccaccaatcacctgtttcccccaatctaccctcctgaaggtcactgacaaagacttcattgtctcctaggagaggctgccatatatcagggctgacgtaattccatcttaatatcagttacattataaaaatttacctcgtgcctgaggccccagagcccaagggtgcaaagcagtaattagtcaaagttcaacttcccctcccactctgggctcaggctgtccctgagggcctgtgttttgagtctctttccagaaccttggtgtgaacttaggtcttggcgtcgggatcccttttcgtcacactcaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaattccagcactttgggaggctgaggtaggaggattgattgaggccaagagttaaagaccagcctggtcaatatagcaagaccacgtctctaaataaaaaataataggccggccagca

SEQ ID NO: 31861 - DNA, 1636 bp, Homo sapiens
aattgacttaatattgttctagaatagcctttcagctacaagaggttatatataaatcaaaagcttcttgagtaaaacttcttagaattgtagaagctgctcaatacggaacatattctcagtcctcctctggtctacaaagcctgtgatttcttgtctatggacagaacgtctggtttaatttacaggaacccataagttcctgaagctttatgcttaacagtgacaacgtgagtcagttgaattttattgtgtttcagtccatagagtattagctacagaaacctttccattgccatactgagaaagtgcagcaggcagtgtgcctacaggtctacaaagaaacttcagatcatcttcttgagggaaagaagctgaagtgctacataagatgcttgtgcttcataactctcagaagctgcagattctgtataaatccttagaaaagagcatccctgaatccataaaggtatatggcgccattttcaacataaaagataaaaaccctttcaacatggaggtgctggtagatgcctggccagattaccagatcgtcattacccggcctcagaaacaggagatgaaagatgaccaggatcattataccaacacttaccacatcttcaccaaagctcctgacaaattagaggaagtcctgtcatactccaatgtaatcagctgggagcaaactttgcagatccaaggttgccaagagggcttggatgaagcaataagaaaggttgcaacttcaaaatcagtgcaggtagattacatgaaaaccatcctctttataccggaattaccaaagaaacacaagacctcaagtaatgacaagatggagttatttgaagtggatgatgataacaagaaaggaaacttttcaaacatgttcttagatgcttcacatgcaggtcttgtgaatgaacactgggcctttgggaaaaatgagaggagcttgaaatatattgaacgctgcctccaggattttctaggatttggcgtgctgggtccagagggccagcttgtctcttggattgtgatggaacggtcctgtgagttgagaatgggttatactgtccccaaatacagacaccaaggcaacatgttgcaaattggttaccatcttgaaaagtatctttctcagaaagaaatcccattttatttccatgtggcagataataatgagaaaagcctacaggcactgaacaatttggggtttaagatttgtccctgtggctggcatcagtggaaatgcacccccaagaaatgttgttgattgattccactgtccatttcaaatctttcttatcagtaaaaaaacattaattcaaacacaagcattgtgatctacattagcacaaaatgcaactgattatctaggatctgtgtattacttaagctcacccttaacagttttaccttccttctcctctgtattcttacagaaaattagaagctcaatttaatggtctcataatttcctttatgacagacatctcagaattaaaatcacccaaagccaatcattagtgccaagataaccctttaacggcaacactttcttaaatgaagactatttctttcatgaaaaaattcacttttatgactttcttgttaaaataaaaagtctgctttt

SEQ ID NO: 31862 - DNA, 777 bp, Homo sapiens
atgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctgacgtcttatattttgccagttagttctgatacatcggcctcaaaaggcccggccttgttcgtttctgaccgtgggaagatggcggttaacgccctttatttgttggttcacaggt

SEQ ID NO: 31863 - DNA, 1251 bp, Homo sapiens
atgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagt

SEQ ID NO: 31864 - DNA, 1313 bp, Homo sapiens
atgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagt

SEQ ID NO: 31865 - DNA, 777 bp, Homo sapiens
atgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgctcggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctgacgtcttatattttgccagttagttctgatacatcggcctcaaaaggcccggccttgttcgtttctgaccgtgggaagatggcggttaacgccctttatttgttggttcacaggt

SEQ ID NO: 31866 - DNA, 1251 bp, Homo sapiens
atgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagt

SEQ ID NO: 31867 - DNA, 1313 bp, Homo sapiens
atgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagt

SEQ ID NO: 31868 - DNA, 785 bp, Homo sapiens
cagcaggaaaccgaagacatgaacaaggtcttcccccagggagagaatggctacactgctgctgaatccaaagcccaccctggaggggaagcaggcggcggccacctctgctgctcacgtcgcggggcctgcctctctgcctctctgctgctcctcctggcaactgtggcggccctcatcgccttggtcaccattcttggactcccatcatgcaccccaggagcccaagcttgtataacactgacaaacaggacaggcttcttgtgccatgaccagaggagctgcattccagccagtggggtctgtgatggcgttcgcacctgtacccacggcgaggacgaggatgagagcttgtgccgagatgtgccccagagcctcccccacttccttgtggcccactgtggagacccggcctcctggatctactcagaccaaaaatgtgatggcactaacaactgcggggactgttcagatgaactgagcccagtaactgtgtgcccaccctgcggccctgggtggtggcgctgtccttcaaccttcttcaagtactgcgactgtataccgaggcatctctgccgcgaccatgtacagcactgctccgactggtccgatgagtatgcctgtcccggaccctgagtgggccactcaggccagcatggaaggctggctggaatggcactgataacccttcacatgaaaatcaaatcctagcgcacaagggcaggaagcagcctttgaaatgggatctacacatcatttctgaataggaattttctctcctcctt

SEQ ID NO: 31869 - DNA, 1652 bp, Homo sapiens
gaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagctccccttcaccttctaccatgagtggaagcagcctgaggtcctcaccacatgcagatgcctgatcttgaactttccagccatcagaattggacaagaaaccaagccaaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttttaaatatgctgtataaaataatggcaaaagacagtgttattaaaatgtttccatcttatttttgattaattgaatatatctatcatgcatctgaaattgcctaggatggttctgattgctggtattcagatccaatgtaactccaaatatttacccatacacttcaagaatgtttgaatgataaggtctctgtgtgctttacaataggatagatttgataccactgaataataaatggcttttgctgagtcagtagcgacctagagcactctacttatagtcattgagtcactcatttattcactaaacatttgttgagcatctacttgatggaactgctgaggatacagtaatgaattggccaggcaattccttccttcagacatgtttgcagaagtctagcagaagagatagacattgaacaatttttaaataattgcatacacagtataattagaattgaaataagggctataggatgctaaaagagattatcacctgatcggagttcaaaggtcagaaaagctttactgacattctataaaaagcaaaaaaaaaaaaattggtccatggatgccagggatatgggtgggaaatggggctgtccacaaatggcacaaggggagttttttattttattttattttattttattttattttattttgagacagagttttgctcttgttgcccaggctggagtgcaatggcacgatctcagcttactgcaacctcgatctcccaggttcaagtgattctcctgcctcagcctcctgagtagctgggattacaggcgtgtgccacgatgccaggctaattttttttgtatttttagtggagacggggtttcgccatgtcggccaggctggtctcgaactcctgacctcaggtgatccgcccacagcctcccaaagtgctgggattacaggcttgagccaccaagtctggccaaggggacttttaagggggctggaaatggtctccattttgattgtgaggtggtggctacaagattgcatgcatttgtcaaactcatagaactgcacactgaaaagagtgaattgtactgtatgtcaattatacctaaataaatctgacttaacaaaaaa

SEQ ID NO: 31870 - DNA, 1574 bp, Homo sapiens
cagaagatgagagaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagggacaagaaaccaagccaaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttttaaatatgctgtataaaataatggcaaaagacagtgttattaaaatgtttccatcttatttttgattaattgaatatatctatcatgcatctgaaattgcctaggatggttctgattgctggtattcagatccaatgtaactccaaatatttacccatacacttcaagaatgtttgaatgataaggtctctgtgtgctttacaataggatagatttgataccactgaataataaatggcttttgctgagtcagtagcgacctagagcactctacttatagtcattgagtcactcatttattcactaaacatttgttgagcatctacttgatggaactgctgaggatacagtaatgaattggccaggcaattccttccttcagacatgtttgcagaagtctagcagaagagatagacattgaacaatttttaaataattgcatacacagtataattagaattgaaataagggctataggatgctaaaagagattatcacctgatcggagttcaaaggtcagaaaagctttactgacattctataaaaagcaaaaaaaaaaaaattggtccatggatgccagggatatgggtgggaaatggggctgtccacaaatggcacaaggggagttttttattttattttattttattttattttattttattttgagacagagttttgctcttgttgcccaggctggagtgcaatggcacgatctcagcttactgcaacctcgatctcccaggttcaagtgattctcctgcctcagcctcctgagtagctgggattacaggcgtgtgccacgatgccaggctaattttttttgtatttttagtggagacggggtttcgccatgtcggccaggctggtctcgaactcctgacctcaggtgatccgcccacagcctcccaaagtgctgggattacaggcttgagccaccaagtctggccaaggggacttttaagggggctggaaatggtctccattttgattgtgaggtggtggctacaagattgcatgcatttgtcaaactcatagaactgcacactgaaaagagtgaattgtactgtatgtcaattatacctaaataaatctgacttaacaaaaaa

SEQ ID NO: 31871 - DNA, 1200 bp, Homo sapiens
agctctggcacaatggcttttcttccttcctgggtttgtgtactagttggttccttttctgcttccttagcagggacttccaatctctcagagacagagccccctctgtggaaggagagtcctggtcagctcagtgactacagggtggagaacagcatgtacattattaatccctgggtataccttgagagaatggggatgtataaaatcatattgaatcagacagccaggtattttgcaaaatttgcaccagataatgaacagaatattttatgggggttgcctctgcagtatggctggcaatataggacaggcagattagctgatccaacccgaaggacaaactgtggctatgaatctggagatcatatgtgcatctctgtggacagttggtgggctgatttgaattattttctgtcttcattaccctttcttgctgcggttgattctggtgtaatggggatatcatcagaccaagtcaggcttttgcccccacccaagaatgagaggaagttttgttatgatgtttctagctgtcgttcatccttccctgagacaatgaacaagtggaacaccttttaccagtatttgcagtcaccttttagtaagtttgatgatctgttgaagtacttatgggctgcacacacttcaaccttggcagataatatcaaaagttttgaagacagatatgattattattctaaagcagaagcgcattttgagagaagttgggtactggctgtggatcatttagctgcagtcctctttcctacaaccttgattagatcatataagttccagaagggcatgccaccacgaattcttcttaatactgatgtagcccctttcatcagtgactttactgcttttcagaatgtagtcctggttcttctaaatatgcttgacaatgtggataaatctataggttatctttgtacagaaaaatctaatgtatatagagatcattcggaatctagctctagaagttatggaaataactcctgaaacatttaacttcaaacttcaggaaatgattaatgaattaaaaatgaaaaactcgaacttgacaatcagtaatttcaaaaaattaatgtcatcatgaccatgtagtttattctttctgatatttttgatttatgcttatttgttaagatcttgtacatgtattaaaaacttaaattaaatgcattcaagttaaaa

SEQ ID NO: 31872 - DNA, 3226 bp, Homo sapiens
gtaaccatgaggggttcctgtgagaggtctggggaggatgaagagcagaaagaagaggctatggtggcctgtgggcgtctttcaggggtccccgaggccgagcagggtcccgaggccaattgggactccgacctggagacggaaggcaccgatgggcttggagaactggtcagggacacactgtacctgaggtcttgccgggcccatagtgttgtgcccatctcctgctttctgcgccaagggagcgcccaagagctgaacctccggcaccgtggcctggggccccagggcgcccgggctctggcttcctcattgagctccaatccatatgtcaagcggctggaccttcgagacaatgggctctgtggggcaggtgcagaggccctggcaggtgccctgagcaaaagcagcagcatccatggtaggtgctgggtctggggcaggtgggcaggcgtgtcctccttttcctcagggatgtgcctccatcgttgaaagctgggccgtgtcacctggggcctgctggtgttgctggtggatagaagaggggcctcatcacaggagggggcatgtggggtggagttagaccctctgctgtgcagccgatgcctgatagaagtcctttcctcacccaccccacaccatcactcccctcccttgctggccagcatccccctcttcacctagcacatgggagactcccagtacctgaatgcaggatgggagagtccttccacacagagaggtgggagttgggcattgtaagaagcaggtaggcaatgtgggagtttgatggggctggatccaaatgccagttctgccactgaagagctggatacctgggcaagcagcttaacctctctgagcttcagtttctgatctgtgaaatggcccccaaaataccttatgggcttggggctgtggtgagcatgaagtgaaatgcactcctgaagtggtcagaagagtgtgtgacccatgtacgtgctccatgcatggccacttgggctattattgccaatcctggcaacggggctgtgagggcttctgaagtgggtggtgatatcactgccagatgcagccatcgacggtatagctgccccccaccacagcagtctctacagtaccaggaggtaggcggttttaaccacttgacacagaagctggtgggcacacagggagggggaggtcaggggcagaggggacccagccattgggagccagagccaccatgcaaccccaggacagttaacctgtaagtccccttcctcagcctcagacctggaggtttgggggatggcagaagtaggggagtgcctggctttgcatcccactggccgaggagtggttctgtcccccagatgtggacctgtcggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcagccacacggaactcttcattccttccacaaatatctcattgcgcgctgctgtatgtgctgggcactgacttagccaccagggatccaccttgaacaaaaccaagttcctgacctcaagggacaatgttaacaacatcattctgagggagacacttggaccagccctggcagaaaacacaggactcaccgagcttaacgtgagctggaatcacctccggggcccaggagctgtggcatttgccaggggactggaggcaaacatcttccttaaagttctagacatctcatacaatggctttggggatcctggagcctctgcggtgggtgaggctctgaaggccaacaacgtgttggaggaactcaacatgagagacagtctcctgctggccttgaactcttgggctgaagcagtcttcctgcctcagcctcccaaagtgctggaattacagtcatggggagttcatcgttgttacatagagacctgtgattcctatagcacaggcggatggctgcgaattgcacacggtgtataaagcatctccggcagagcctggtgcatgtaacaaccgcatctctgcgatgggagccctgagcctgggcctgggcctccgggtcaaccagacgctgaggattcttgtacagcctcaccagagcattctgtctgactatctgatggagacaccttctgagccgaaacagtgtggccatagtggctgtgtcctcagagatgaggagcccctccttccctttcacattgctctctggccttcccggacctggcttctcgcagctttgtgtgcgtgtttctcaggtgtccaggaatcccatgcgaagtgaaggctgctttggtctcctcaagtctgtccaggacaatccagcctctgccctggaactgctggatttctcagatatccaggtgaacgcagagtttgatggccttgctagctcagtgaggggaattcttccagaactctgcataaagactggcgcttgcagagtggagtataaaaaggagttgctgccagtcttcagatcagccctgccagcgtctgtccctaagtgaccttggagtgtggcttcctcatctccaatcagctgctttgacctccagggtatatacttgaaagaaatgaagacatatgtccccacaagaactcgtgcacgaatatccatagcaacattatttataatattctaagagtgaaaatgcccaccagtggataaatgcaatgtggtatatccatacagtggaatattatttggcaataaaaaggaatttgaggtgataccaatgttctaaaatgtattgtggtgatggctacgtaactgtgcatattctaaaggcaattgaattacagatgctttacatgaatgaaccgtatggtatgtgaacggcatctcaataaaactgtttcgaaaagaaggaaaaggacggacacatgctgaaaacgggtgaaactagaaaacatggcgctaagtgaaagaagccagccacaagatcacgtgtcgcatgaccgcatttatgtgaaacatccggagtacgcaaatctatacagacagaaagtagattatacattgcctaggtgcagagaaatggaagtattggaggttgacggctaaaggatgtggatttctttggggggtgataaaagtgttctaaaattg

SEQ ID NO: 31873 - DNA, 787 bp, Homo sapiens
atggcggctttttgcgccccaccccccctcgtgccgcggttatttgcccgcggcggctttttgcaccccaggcgccgcggctttttgccccccgcccccgtggctttttgccccatggccatcctcagaagcgctggccacacctggtgcaggagtcagccccagtcaggacacagcacggacgtgagggcccccactcagctcctggggctcctggggctcctggggctctggctgccaggtgccagatgtgacatccagatgacccagtctccatcctccctgtctgcatctgtaggaggcagagtcaccatcacttgccgggcgagtcagggcattagcaataatttaaattggtatcagcagaaaccaaggaaaactcctaagctcctgatctatgctgcatccagtctgcaaagtgggattccctctcggttcagtgacagtggatctgggacagattacactctcaccatcagcagcctgcagcctgaagattttgcaacttattactgtcaacagagtgacagtaaccctcccacagtgttacaagtcataacataaaccccaaggaagtagatgtgtgaggctgggctgccccaatgctccttctggtgcctctatctgctgagggaagttctcaaactcagtcaggtttggaaagtcatcgggagattttcctagaggaggccagggaggttcctctgaacgctaagcctctttcgccctcatccccagcagaaaagacgtgacaatgcctgtcctgactgaataaagaagagagata

SEQ ID NO: 31874 - DNA, 1074 bp, Homo sapiens
atgggcatgcgtggcgtggcgcgaatcctgtccctgtcgctcgtcctggccgcggtggccacgggggcctgggagcgggggccgctgggcgtgctcttgccctggcagggctccgccgcgctgggccgctgctgtcctggccgtgacccgatgtttgtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaaggctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccagacaccaccttctcttccagcagtctcctgcactgtggcacagtggagtggctgcagtcgctgtgtgaaacctgccaggtctcctaccatgtacaccggaggcgtgtcctgcaggagccgaggaatgggggtgtccccttcccgctgctggaagagcgggctggctgtgtggagtactggagccaccagggagtggagtgccagcagtcattgcatgagtggggatgggccccaggggtggctctcagtgggaacatccctgctttgataaccacaggcagctacgggaaagagtgggaaaagtactgtgtccagttccagttggggtccattccagggagctgcgggcaggcgagggcaccccatgcccagtggacaaggtatctgagtcagggccacacggtctgtgtgaggagtgaatggcctgcccaggacaccaggagccggcgctgctacggggacggtggtggggccaaagggaacaagatgtggctgtggcaagcggccagccatccccggtgccgagggacctgggagaagctagggcagctccggcattgttcctgccctgtggtccacagcctcgtcttcatctag

SEQ ID NO: 31875 - DNA, 1579 bp, Homo sapiens
cagaagatgagagaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagggacaagaaaccaagccaaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttttaaatatgctgtataaaataatggcaaaagacagtgttattaaaatgtttccatcttatttttgattaattgaatatatctatcatgcatctgaaattgcctaggatggttctgattgctggtattcagatccaatgtaactccaaatatttacccatacacttcaagaatgtttgaatgataaggtctctgtgtgctttacaataggatagatttgataccactgaataataaatggcttttgctgagtcagtagcgacctagagcactctacttatagtcattgagtcactcatttattcactaaacatttgttgagcatctacttgatggaactgctgaggatacagtaatgaattggccaggcaattccttccttcagacatgtttgcagaagtctagcagaagagatagacattgaacaatttttaaataattgcatacacagtataattagaattgaaataagggctataggatgctaaaagagattatcacctgatcggagttcaaaggtcagaaaagctttactgacattctataaaaagcaaaaaaaaaaaaattggtccatggatgccagggatatgggtgggaaatggggctgtccacaaatggcacaaggggagttttttattttattttattttattttattttattttattttattttgagacagagttttgctcttgttgcccaggctggagtgcaatggcacgatctcagcttactgcaacctcgatctcccaggttcaagtgattctcctgcctcagcctcctgagtagctgggattacaggcgtgtgccacgatgccaggctaattttttttgtatttttagtggagacggggtttcgccatgtcggccaggctggtctcgaactcctgacctcaggtgatccgcccacagcctcccaaagtgctgggattacaggcttgagccaccaagtctggccaaggggacttttaagggggctggaaatggtctccattttgattgtgaggtggtggctacaagattgcatgcatttgtcaaactcatagaactgcacactgaaaagagtgaattgtactgtatgtcaattatacctaaataaatctgacttaacaaaaaa

SEQ ID NO: 31876 - DNA, 1657 bp, Homo sapiens
gaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagctccccttcaccttctaccatgagtggaagcagcctgaggtcctcaccacatgcagatgcctgatcttgaactttccagccatcagaattggacaagaaaccaagccaaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttttaaatatgctgtataaaataatggcaaaagacagtgttattaaaatgtttccatcttatttttgattaattgaatatatctatcatgcatctgaaattgcctaggatggttctgattgctggtattcagatccaatgtaactccaaatatttacccatacacttcaagaatgtttgaatgataaggtctctgtgtgctttacaataggatagatttgataccactgaataataaatggcttttgctgagtcagtagcgacctagagcactctacttatagtcattgagtcactcatttattcactaaacatttgttgagcatctacttgatggaactgctgaggatacagtaatgaattggccaggcaattccttccttcagacatgtttgcagaagtctagcagaagagatagacattgaacaatttttaaataattgcatacacagtataattagaattgaaataagggctataggatgctaaaagagattatcacctgatcggagttcaaaggtcagaaaagctttactgacattctataaaaagcaaaaaaaaaaaaattggtccatggatgccagggatatgggtgggaaatggggctgtccacaaatggcacaaggggagttttttattttattttattttattttattttattttattttattttgagacagagttttgctcttgttgcccaggctggagtgcaatggcacgatctcagcttactgcaacctcgatctcccaggttcaagtgattctcctgcctcagcctcctgagtagctgggattacaggcgtgtgccacgatgccaggctaattttttttgtatttttagtggagacggggtttcgccatgtcggccaggctggtctcgaactcctgacctcaggtgatccgcccacagcctcccaaagtgctgggattacaggcttgagccaccaagtctggccaaggggacttttaagggggctggaaatggtctccattttgattgtgaggtggtggctacaagattgcatgcatttgtcaaactcatagaactgcacactgaaaagagtgaattgtactgtatgtcaattatacctaaataaatctgacttaacaaaaaa

SEQ ID NO: 31877 - DNA, 2918 bp, Homo sapiens
ggaaagaggagttgcttcacccacagtcagtgctattgcatcaaccaatccctgccattctgcagtttcctggtgtatctgcccggagtcacacagtctttcctgctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagagcgcagactaccagaacctctgccatctccgatactgtgagtcaggccaaggtccaagtcaacaaggccttcctggactcccgaaccaggctgaagaccgccatgagctctgagactcccaccagccgacagctctcagaatacctcaagcatgccaaaggccggacgcgcacagccatccgcaatggacaggtgtgggaggagtctttaaagagactgaggcagaaggcatccttgaccaatgtcacagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaagatgctaggcgtgacaccgttccctccaaaagcagacctcggaatcactgccaaataagtaactagacgtttacaggcca

SEQ ID NO: 31878 - DNA, 43816 bp, Homo sapiens
aagcgttgcacaattcccccaacctccatacatacggcagctcttctagacacaggttttcccaggtcaaatgcggggaccccagccatatctcccaccctgagaaattttggagtttcagggagctcagaagctctgcagaggccaccctctctgaggggattcttcttagacctccatccagaggcaaatgttgacctgtccatgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccttgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgacttacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaacaactgatggaacgctagtgaccaccataaagatgtcaagccaggcagcacaaggaaattccacgtggcctgccccagcagaggagacggggagcagtccagcaggcacatccccaggaagcccagaaatgtctaccactctcaaaatcatgagctccaaggaacccagcatcagcccagagatcaggtccactgtgagaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggtttcaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtaagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtgtctctgccctctggagaccaaggcattacaagcctcaccaatccctcaggaggaaaaacaagctctgcgtcatctgtcacatctccttcaatagggcttgagactctgagggccaatgtaagtgcagtgaaaagtgacattgcccctactgctgggcatctatctcagacttcatctcctgcggaagtgagcatcctggacgtaaccacagctcctactccaggtatctccaccaccatcaccaccatgggaaccaactcaatctcaactaccacacccaacccagaagtgggtatgagtaccatggacagcaccccggccacagagaggcgcacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaggaccctgaatacgctggacataaacttggaatctgggacgacttcatccccaagttggaaaagcagcccatatgagagaattgccccttctgagtccaccacagacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgtcctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttccagatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccctgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccacaaatgtattgggcacaacaagcccagagcccgtaacgagttcacctccaaatttaagcagccccacacaggagagactgaccacttacaaagacactgcgcacacagaagccatgcatgcttccatgcatacaaacactgcagtggccaacgtggggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcagtggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccctggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctctggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccattggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacttctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttctcaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagcggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggacacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcaaccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccatcactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaatacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctctctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcatcacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaacaactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaggacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagccacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagagacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagaaaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttccaggaagttcaacgccacagagagagaactgcagggtctgctcaaacccttgttcaggaatagcagtctggaatacctctattcaggctgcagactagcctcactcaggccagagaaggatagctcagccacggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatggctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccagcagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggcccctacaccctggacaggaacagtctctatgtcaatggtttcacccattggatccctgtgcccaccagcagcactcctgggacctccacagtggaccttgggtcagggactccatcctccctccccagccccacaactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaaccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggatggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcactaacctgcagtatgaggaggacatgcgtcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcgga

SEQ ID NO: 31879 - DNA, 1049 bp, Homo sapiens
ggagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcaaaaaaaaaaaaaaaaaaaaaaaaaaaaa

SEQ ID NO: 31880 - DNA, 1094 bp, Homo sapiens
ggagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgggtcttcccccaacagaactatttcttgctgctcaatccattccctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttatgcaaaaaaaaaaaaaaaaaaa

SEQ ID NO: 31881 - DNA, 947 bp, Homo sapiens
aattgagtatctggcaagagtaagattaagcagtaatttgttccaaagaagaatcttctaccaaggagcaactttaaagaatgaaattaactttcttcttgggcctgttggctcttatttcatgtttcacacccagtgagagtcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaaccaccaggcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaactgctctgatatcttagaagaaataaactgcaatgattttgatggaaccaaccctgatctaaccagcacactaaataaagtatttgagcaata

SEQ ID NO: 31882 - DNA, 507 bp, Homo sapiens
cagagcctccttcaagatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccaacgaggacaccgtcaactctctctaccccgatttccttctgtcagcctgcaggaagcatcatcattcttccggagggacagaccagcaagacatccccaggagcaaccactctggtaatctagaattcagtggcagaaaataaataagaagataacttccttcagaaagccatgacattgaaataatgtggtcataactctttc

SEQ ID NO: 31883 - DNA, 6999 bp, Homo sapiens
cctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacccccggcggggacacggcgggcgcggggcggtgcggcgggcggcgggcggcaaagttggggccgggccgccgcggctggtgggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacacctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctgtctgaaaacagctctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctcygtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggccacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaayggccttcttcagggatacaggatctactacagggagctggagtatgaagccgggtcaggcacygaggccaagacgctcaaaaaccctatagctttacrtgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttc

SEQ ID NO: 31884 - DNA, 1694 bp, Homo sapiens
ctctctgcccacctctgcttcctctaggaacacaggagttccagatcacatcgagttcaccatgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccagaccagtgtggaatctgttgattttgcaaatgctccagaagaaagtcgaaagaagattaactcctgggtggaaagtcaaacgaatgaaaaaattaaaaacctaattcctgaaggtaatattggcagcaataccacattggttcttgtgaacgcaatctatttcaaagggcagtgggagaagaaatttaataaagaagatactaaagaggaaaaattttggccaaacaagaatacatacaagtccatacagatgatgaggcaatacacatcttttcattttgcctcgctggaggatgtacaggccaaggtcctggaaataccatacaaaggcaaagatctaagcatgattgtgttgctgccaaatgaaatcgatggtctccagaagcttgaagagaaactcactgctgagaaattgatggaatggacaagtttgcagaatatgagagagacacgtgtcgatttacacttacctcggttcaaagtggaagagagctatgacctcaaggacacgttgagaaccatgggaatggtggatatcttcaatggggatgcagacctctcaggcatgaccgggagccgcggtctcgtgctatctggagtcctacacaaggcctttgtggaggttacagaggagggagcagaagctgcagctgccaccgctgtagtaggattcggatcatcacctacttcaactaatgaagagttccattgtaatcaccctttcctattcttcataaggcaaaataagaccaacagcatcctcttctatggcagattctcatccccgtagatgcaattagtctgtcactccatttggaaaatgttcacctgcagatgttctggtaaactgattgctggcaacaacagattctcttggctcatatttcttttctttctcatcttgatgatgatcgtcatcatcaagaatttaatgattaaaatagcatgcctttctctctttctcttaataagcccacatataaatgtactttttcttccagaaaaattctccttgaggaaaaatgtccaaaataagatgaatcacttaataccgtatcttctaaatttgaaatataattctgtttgtgacctgttttaaatgaaccaaaccaaatcatactttttctttgaatttagcaacctagaaacacacatttctttgaatttaggtgatacctaaatccttcttatgtttctaaattttgtgattctataaaacacatcatcaataaaatagtgacataaaatca

SEQ ID NO: 31885 - DNA, 7557 bp, Homo sapiens
ggttattaactgtaagactgtttgaattgtcaggtctttgtggtgagctgaattctgcatggcagtgcttactgtgcagaaaggttgcaatgcctcactttgccttaatccatgttcctctaacttccttactctttctctcaagaggaggcaagtggctgtggcggccgcagcagtggctgatcatcactgaaaataccaaagaaaagaactgagctgcctccttcatattttttccattgaggattaatttaccgtgctttttcattttctctacatcctgcaaaagtttttttctctcctaagaaacaaactatgaactgattgttgaaaaaaagaagtaaaaagttttagcacagcttctctgtctcttcgggacaagttagaaaattctgaagtgagccgaagcatagtaagtgctttctttctttttaagctacttctggggagggaggaggctattgtaatggtaaatttcactccgagaggaagaaagggttgataatcaatcaaaaatgaggtattcctttgagtatttgtgattttcttactatattgtaagatgcttttaattttctctgtaaaataggcagaaatggttttagtgtgtgtatgtgtgaaataaaagctcagaaaagcaatcttcagagcgccactgaaggaagttttgacgaacggagtagagatgtataccacttgggggcttcagtgagaacccagaattcctggaggaggatttacattcagaaatgttgaagtgaaaattccttctggttcagcatcttggagttcagcttggaagaacattttacgtatggaagaatttgcttctccaaacctctcttttggccattgtgtgtcctgaaggatgggacaacttgtgctgtagaagcactgcttgcctgagtttgcttcaggcattttaaatttaacttgagggatcatgtgtttggcatgatgaggaccactgaagacttccacaagcctagtgccacattaaactctaacacggccaccaagggaaggtacatttatctggaggcattcctggagggaggagctccctggggttttactctaaagggtggcctggagcacggagaaccattaatcatctctaaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagagatgtgtgcacagacccaggccatgcagatactggtgcctctaacttcgtcagcccagaacacctcacctctggcccccagcacaggaaagcagcgtggtcaggaggggttaaacttcggctgaagcacaggtctagtgagcctgcaggccgacctcactcgtggcacacaactaaatctggggagaagcaacccgatgccagcatgatgcagatatctcagggtatgatcggccctccttggcaccaaagctaccattccagctcctctactagtgacctctccaactatgaccatgcttatctaaggcggagccctgaccagtgcagctcccaggggagcatggagagcctggagcccagtggggcatacccaccctgtcatctttcccctgccaagtccaccggcagcattgaccagctcagccacttccataacaagagagactcggcttacagctctttctccaccagttctagcatcctagagtatccacaccctggcatctctgcccgggagcgttcaggctccatggacaatacttctgctcgaggtggcctcctcgaagggatgaggcaggcagatattcgctatgtcaagacagtctatgacacccggaggggagtctcagcagagtatgaggtgaactcttcagccctgctgcttcaaggtagggaggcccgagcctcagcaaatggtcagggctatgataaatggtctaatattcctcggggcaagggagtgccacccccatcctggagccagcagtgccccagttccttggagactgccacggacaaccttcctcctaaggtgggtgcacccctgcctccagctcggagtgacagttacgcagcatttcggcaccgtgagcggcccagctcctggtctagccttgatcagaaacggctctgccggcctcaggcaaactctttaggctccctgaagtctccattcatagaggagcagctgcatactgtgctggagaagagtccagagaacagccccccagtgaagcccaagcataactatacccagaaggcccaacctggccaacctctgctgccgaccagcatctacgcggtaccttccctggagccacactttgcccaggtgcctcagccttctgtgagtagcaacggtatgctctaccctgcactggccaaggagagtggatacatagcccctcagggagcatgcaacaagatggctaccattgatgagaatgggaaccagaatggatctggcaggcctgggtttgccttctgccagcccttagaacatgacttgctgtccccagtggagaagaaaccagaagctacagccaagtatgtcccctccaaagtccatttctgttcagtgcctgaaaatgaggaggatgcctccctgaagagacatctcacacctccccaaggcaacagcccacattccaatgagagaaagagcacccacagtaacaaaccatcttctcatccccacagcctcaaatgccctcaggctcaggcctggcaagcgggtgaagacaagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgggccggagggggcccggcccaggcagcgcctcggctcttcagggctttcagtacgggaagccccactgctcggtgctggagaaggtctccaaattcgagcagcgagagcaagggagccagagaccgagtgtgggcggctctggttttggccataactataggccccacaggaccgtctcaacttccagtacttctgggaatgacttcgaggagacaaaagcacacattcgtttctctgagtcagctgaacccctaggcaacggggagcagcacttcaaaaacggggagctgaagttggaagaggcttcccggcagccctgcggtcagcagctgagcggaggagcgtcggacagcggccgtggcccccagaggccggacgctcggctcctccgtagccagagcaccttccagctctccagcgagccagagagggagcccgagtggcgggacaggcccggctcgcccgaatcgcccctgctggatgcccccttcagccgcgcctaccggaacagcatcaaggacgcacagtcccgtgtcttgggggccacctcctttcgacgtcgagacctggagctgggggcgcccgtggcgtcgaggtcctggcggccacggccttcctcggcccacgtggggctgcggagccccgaggcgtcggcctccgcctccccgcacacgccccgggagcggcacagcgtgacccctgctgagggcgacctggccaggcccgtgccccctgccgcccggagaggtgctcgccggcgcctgactcccgagcagaagaagcgctcctactcggagcccgagaagatgaacgaggtggggatcgtggaggaggccgaaccggcacccctgggcccgcagagaaatgggatgcgtttcccggagagcagcgtggccgaccggcgccgtctcttcgagcgcgatggcaaggcctgctccacgctcagcctgtcggggcccgagctgaagcagttccagcagagcgccctggcggactacatccagcgcaagaccggcaagcggcctacctccgccgccggctgcagcctccaggagcccgggccactgcgtgagcgcgcccagagtgcctacctccagcccggccccgcggcgctcgaaggctccggcctcgcctcggcctccagcttgagctcactgcgggagcccagcctgcagccccgcagggaggccacgctcctgccggccacagttgcagaaacccagcaggctccccgagatcgcagcagctccttcgccggtggccgccgcctcggggaacggcgacgcggggacctgcttagcggagcaaacggtggaacaaggggcacccagagaggggatgagacccccagggagccatcctcctggggggccagggccgggaagtccatgtcggccgaggacctgctggaacgctcggacgtccttgcgggccctgtccatgtgaggtccaggtcatctcccgccaccgcagacaagcgccaggatgtgcttttggggcaagacagtggctttggtcttgtgaaggatccatgttatttggctggtcctggatctaggtcactcagttgttcagaaagaggccaagaagagatgctgctgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctcacaggacggtcagacagggcgacagcctctcccgccctacacccctgccatgatgcacagaagcaatggtcacaccctgacccagcctcccggtccaagaggctgtgagggcgatggcccagagcatggggtagaagagggaacgaggaagagggtctcgctgcctcagtggccacctccttctcgagcaaagtgggcccacgcagccagagaggacagccttcctgaggaatcctcagcccctgattttgcaaacctgaagcactatcaaaaacagcagagtcttccaagtttatgcagcacttctgacccagacacacctcttggggccccgagcactccagggaggatctccctccgaatatctgagtctgtcctgcgggactccccgccacctcatgaggattatgaagacgaagtgtttgtgagggatccgcaccccaaggccacgtccagccccacatttgaacctcttcccccacccccacctcctccaccgagtcaggaaaccccggtgtatagcatggatgacttccctccacctcctccccacactgtatgtgaggcgcagctggacagtgaggatcccgaggggccacgccccagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccagcagaagtgaatgaggaagaggaacaggcagatgtcaatgaaaagaaggctgagctcattggaagtctcacccacaagctggagaccctccaggaggcgaaggggagcctgctcacggacatcaagctcaacaacgccctgggagaagaggtggaggctctgatcagcgagctctgcaagcccaatgagtttgacaagtataggatgttcataggggatttggacaaggtggtcaacctgctgctctccctctcggggcgtctagcccgtgttgagaatgtccttagcggccttggtgaagatgccagtaatgaagaaaggagctctctttacgagaaaaggaagatcctggctggtcagcatgaggatgcccgggagctgaaggagaacctggatcgcagggagcgagtagtgctgggcatcttggccaattacctttcagaggagcagctccaggactaccagcacttcgtgaaaatgaagtccacgctcctcattgagcaacggaagctggatgacaagatcaagctgggccaggagcaggtcaagtgtctgctggagagcctgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagat

SEQ ID NO: 31886 - DNA, 6891 bp, Homo sapiens
ggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtcttgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccaaaaaaaaaaaaaaaaaaaaaaaaaaaaaaaa

SEQ ID NO: 31887 - DNA, 2800 bp, Homo sapiens
atttgagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctccagagaactatatgaatgttgcatagtactgtggctgtgtaacagaagaaacacactaaactaattacaaagttaacaatttcattacagttgtgctaaatgcccgtagtgagaagaacaggaaccttgagcatgtatagtagaggaacctgcacaggtctgatgggtcagaggggtcttctctgggtttcactgaggatgagaagtaagcaaactgtggaaacatgcaaaggaaaaagtgatagaataatattcaagacaaaaagaacagtatgaggcaagagaaataatatgtatttaaaatttttggttactcaatatcttatacttagtatgagtcctaaaattaaaaatgtgaaactgttgtactatacgtataacctaaccttaattattctgtaagaacatgcttccataggaaatagtggataattttcagctatttaaggcaaaagctaaaatagttcactcctcaactgagacccaaagaattatagatatttttcatgatgacccatgaaaaatatcactcatctacataaaggagagactatatctattttatagagaagctaagaaatatacctacacaaacttgtcaggtgctttacaactacatagtactttttaacaacaaaataataattttaagaatgaaaaatttaatcatcgggaagaacgtcccactacagacttcctatcactggcagttatatttttgagcgtaaaagggtcgtcaaacgctaaatctaagtaacgaattgaaagtttaaagagggggaagagttggtttgcaaaggaaaagtttaaatagcttaatatcaatagaatgatcctgaagacagaaaaaactttgtcactcttcctctctcattttctttctctctctctccccttctcatacacatgcctcccccaccaaagaatataatgtaaattaaatccactaaaatgtaatggcatgaaaatctctgtagtctgaatcactaatattcctgagtttttatgagctcctagtacagctaaagtttgcctatgcatgatcatctatgcgtcagagcttcctccttctacaagctaactccctgcatctgggcatcaggactgctccatacatttgctgaaaacttcttgtatttcctgatgtaaaattgtgcaaacacctacaataaagccatctacttttagggaaagggagttgaaaatgcaaccaactcttggcgaactgtacaaacaaatctttgctatactttatttcaaataaattctttttaaaataaaaaaaaaaaaaaaaaaa

SEQ ID NO: 31888 - DNA, 870 bp, Homo sapiens
ctcgccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcaaaaaaaaaaaaaaaaaa

SEQ ID NO: 31889 - protein, 175 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 31890 - protein, 153 aa, Homo sapiens
MPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 31891 - protein, 484 aa, Homo sapiens
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKDALVLTPASLWKPSSPVSQ

SEQ ID NO: 31892 - protein, 604 aa, Homo sapiens
MAKESGISLKEIQVLARQWKVGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 31893 - protein, 575 aa, Homo sapiens
MPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 31894 - protein, 295 aa, Homo sapiens
MIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERNVPLATDLIRISQYRFTVSDLMRMEKIVLEKVCWKVKATTAFQFLQLYYSLLQENLPLERRNSINFERLEAQLKACHCRIIFSKAKPSVLALSIIALEIQAQKCVELTEGIECLQKHSKINGRDLTFWQELVSKCLTEYSSNKCSKPNVQKLKWIVSGRTARQLKHSYYRITHLPTIPEMVP

SEQ ID NO: 31895 - protein, 295 aa, Homo sapiens; identical to SEQ ID NO: 31894

SEQ ID NO: 31896 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 31897 - protein, 1091 aa, Homo sapiens
MCRKKPDTMILTQIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 31898 - protein, 1528 aa, Homo sapiens
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVQDEFLDTPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 31899 - protein, 767 aa, Homo sapiens
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 31900 - protein, 1093 aa, Homo sapiens
MLCKKKKIPCSEEFLLSKTLGDPVKIRAWNIAGLPTDTFSIDNGVIVNNCRRWPLMIDPQGQANKWIKNSERENQLSVIKLSDSDYMRTLENCIQFGTPLLLENVGEELDPSLEPLLLRQTFKQGGIDCIRLGEVIIEYSFDFKFYITTKLRNPHYMPELATKVSLLNFMITPEGLEDQLLGIVVAKERPELEEERNALILQSAANKKQLKDIEKKILETLSSSEGNILEDESAIKVLDSAKMMSNEITKKQQIAEKTELKIAESREGYRPIAKHSSVLFFSIADLANIDPMYQYSLTWFVNLYINSIHDSNKSKILEKRLRYLNDHFTYNLYCNICRSLFEKDKLLFSFLLCANLLLARKEIEYQELMFLLTGGVSLKSAEKNPDPTWLQDKSWEEICRASEFPAFRGLRQHFCEHIYEWREIYDSKEPHNAKFPAPMDKNLNELQKIIILRCLRPDKITPAITNYVTDKLGKKFVEPPPFDLTKSYLDSNCTIPLIFVLSPGADPMASLLKFANDKSMSGNKFQAISLGQGQGPIAAKMIKAAIEEGTWVCLQNCHLAVSWMPMLEKICEDFTSETCNSSFRLWLTSYPSSKFPVTILQNGVKMTNEPPTGLRLNLLQSYLTDPVSDPEFFKGCRGKELAWEKLLFGVCFFHALVQERKKFGPLGWNIPYGFNESDLRISIRQLQLFINEYDTIPFEAISYLTGECNYGGRVTDDWDRRLLLTMLADFYNLYIVENPHYKFSPSGNYFAPPKGTYEDYIEFIKKLPFTQHPEIFGLHENVDISKDLQQTKTLFESLLLTQGGSKQTGASGSTDQILLEITKDILNKLPSDFDIEMALRKYPVRYEESMNTVLVQEMERFNNLIITIRNTLRDLEKAIKGVVVMDSALEALSGSLLVGKVPEIWAKRSYPSLKPLGSYITDFLARLNFLQDWYNSGKPCVFWLSGFFFTQAFLTGAMQNYARKYTTPIDLLGYEFEVIPSDTSDTSPEDGVYIHGLYLDGARWDRESGLLAEQYPKLLFDLMPIIWIKPTQKSRIIKSDAYVCPLYKTSERKGTLSTTGHSTNFVIAMLLKTDQPTRHWIKRGVALLCQLDD

SEQ ID NO: 31901 - protein, 304 aa, Homo sapiens
MNIVFSRDSQVRVMENTVANTEKYFGQFCSLLAAYTRKTARLRDKADQLVKQLIDFANSENPELRATMRGFAEDLAKVQDYRQAQVERLETKVVNPLKLYGAQIKQTRAEIKKFKHVQNHEIKQLEKLEKLRQKSPSDQQMISQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQGTLQVQLSRANEDPEHPHANHGRFSLCEWVVKGQPAHCVCGQGGHLMLPGHSL

SEQ ID NO: 31902 - protein, 361 aa, Homo sapiens
MDPLGAAKPQWPWRRCLAALLFQLLVAVCFFSYLRVSRDDATGSPRAPSGSSRQDTTPTRPTLLILLWTWPFHIPVALSRCSEMVPGTADCHITADRKVYPQADTVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 31903 - protein, 294 aa, Homo sapiens
MLVLHNSQKLQILYKSLEKSIPESIKVYGAIFNIKDKNPFNMEVLVDAWPDYQIVITRPQKQEMKDDQDHYTNTYHIFTKAPDKLEEVLSYSNVISWEQTLQIQGCQEGLDEAIRKVATSKSVQVDYMKTILFIPELPKKHKTSSNDKMELFEVDDDNKKGNFSNMFLDASHAGLVNEHWAFGKNERSLKYIERCLQDFLGFGVLGPEGQLVSWIVMERSCELRMGYTVPKYRHQGNMLQIGYHLEKYLSQKEIPFYFHVADNNEKSLQALNNLGFKICPCGWHQWKCTPKKCC

SEQ ID NO: 31904 - protein, 117 aa, Homo sapiens
MTAPKAFAGLSRPQRKGNPSSGLVRVKRDMARKRTSPGGPACRGKGAGLDAAWTTTRAPRAVLLETTFPRATRAERAGKRAFRVQCAGAKAIFGYIREVQEAIRSFASAVPGVWYFS

SEQ ID NO: 31905 - protein, 117 aa, Homo sapiens; identical to SEQ ID NO: 31904

SEQ ID NO: 31906 - protein, 117 aa, Homo sapiens; identical to SEQ ID NO: 31904

SEQ ID NO: 31907 - protein, 117 aa, Homo sapiens
MTAPKAFAGLSRPQRKGNPSSGLVRVKRDMARKRTSPGGPACRGKGAGLDAAWTTTRAPRAVLLETTFPRATRAERAGKRAFRVQCAGAKAIFGYIREVQEAIRSFASAVLGVWYFS

SEQ ID NO: 31908 - protein, 117 aa, Homo sapiens; identical to SEQ ID NO: 31907

SEQ ID NO: 31909 - protein, 117 aa, Homo sapiens; identical to SEQ ID NO: 31907

SEQ ID NO: 31910 - protein, 205 aa, Homo sapiens
MNKVFPQGENGYTAAESKAHPGGEAGGGHLCCSRRGACLSASLLLLLATVAALIALVTILGLPSCTPGAQACITLTNRTGFLCHDQRSCIPASGVCDGVRTCTHGEDEDESLCRDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 31911 - protein, 177 aa, Homo sapiens
MGGCMHSTQDKSLHLEGDPNPSAAPTSTCAPRKMPKRISISKQLASVKALRKCSDLEKAIATTALIFRNSSDSDGKLEKAIAKDLLQTQFRNFAELPFTFYHEWKQPEVLTTCRCLILNFPAIRIGQETKPKYREILSELDEHTENKLDFEDFMILLLSITVMSDLLQNIRNVKIMK

SEQ ID NO: 31912 - protein, 147 aa, Homo sapiens
MGGCMHSTQDKSLHLEGDPNPSAAPTSTCAPRKMPKRISISKQLASVKALRKCSDLEKAIATTALIFRNSSDSDGKLEKAIAKDLLQTQFRNFAEGQETKPKYREILSELDEHTENKLDFEDFMILLLSITVMSDLLQNIRNVKIMK

SEQ ID NO: 31913 - protein, 330 aa, Homo sapiens
MAFLPSWVCVLVGSFSASLAGTSNLSETEPPLWKESPGQLSDYRVENSMYIINPWVYLERMGMYKIILNQTARYFAKFAPDNEQNILWGLPLQYGWQYRTGRLADPTRRTNCGYESGDHMCISVDSWWADLNYFLSSLPFLAAVDSGVMGISSDQVRLLPPPKNERKFCYDVSSCRSSFPETMNKWNTFYQYLQSPFSKFDDLLKYLWAAHTSTLADNIKSFEDRYDYYSKAEAHFERSWVLAVDHLAAVLFPTTLIRSYKFQKGMPPRILLNTDVAPFISDFTAFQNVVLVLLNMLDNVDKSIGYLCTEKSNVYRDHSESSSRSYGNNS

SEQ ID NO: 31914 - protein, 161 aa, Homo sapiens
MRGSCERSGEDEEQKEEAMVACGRLSGVPEAEQGPEANWDSDLETEGTDGLGELVRDTLYLRSCRAHSVVPISCFLRQGSAQELNLRHRGLGPQGARALASSLSSNPYVKRLDLRDNGLCGAGAEALAGALSKSSSIHGRCWVWGRWAGVSSFSSGMCLHR

SEQ ID NO: 31915 - protein, 187 aa, Homo sapiens
MAAFCAPPPLVPRLFARGGFLHPRRRGFLPPAPVAFCPMAILRSAGHTWCRSQPQSGHSTDVRAPTQLLGLLGLLGLWLPGARCDIQMTQSPSSLSASVGGRVTITCRASQGISNNLNWYQQKPRKTPKLLIYAASSLQSGIPSRFSDSGSGTDYTLTISSLQPEDFATYYCQQSDSNPPTVLQVIT

SEQ ID NO: 31916 - protein, 357 aa, Homo sapiens [sequence omitted]

SEQ ID NO: 31917 - protein, 147 aa, Homo sapiens; identical to SEQ ID NO: 31912

SEQ ID NO: 31918 - protein, 177 aa, Homo sapiens; identical to SEQ ID NO: 31911

SEQ ID NO: 31919 - protein, 712 aa, Homo sapiens
MRVLLHLPALLASLILLQAAASTTRAQTTRTSAISDTVSQAKVQVNKAFLDSRTRLKTAMSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 31920 - protein, 14507 aa, Homo sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 31921 - protein, 256 aa, Homo sapiens
MFQTGGLIVFYGLLAQTMAQFGGLPVPLDQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 31922 - protein, 256 aa, Homo sapiens; identical to SEQ ID NO: 31921

SEQ ID NO: 31923 - protein, 201 aa, Homo sapiens
MKLTFFLGLLALISCFTPSESQRFSRRPYLPGQLPPPPLYRPRWVPPSPPPPYDSRLNSPLSLPFVPGRVPPSSFSRFSQAVILSQLFPLESIRQPRLFPGYPNLHFPLRPYYVGPIRILKPPFPPIPFFLAIYLPISNPEPQINITTADTTITTNPPTTATATTRHFHKTHNDDQLLNSTYLFNTRACHLHISSNPRSIY

SEQ ID NO: 31924 - protein, 134 aa, Homo sapiens
MLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPQRGHRQLSLPRFPSVSLQEASSFFRRDRPARHPQEQPLW

SEQ ID NO: 31925 - protein, 2213 aa, Homo sapiens
  VARIANT 1641: Xaa = Any Amino Acid
MARGARPSAAGGGGGGAEPPERAGPGRPRGSPPGRARPSLAPRPGPEPSRPRAAPETPGGDTAGAGRCGGRRAAKLGPGRRGWWALLALQLHLLRALAQDDVAPYFKTEPGLPQIHLEGNRLVLTCLAEGSWPLEFKWMRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRHLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENSSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQVGAIGDEEEWVTLYEEENEPDAQMLEIPNLTPYTHYRFRMKQVNIVGPSPYSPSSRVIQTLQAPPDVAPTSVTVRTASETSLRLRWVPLPDSQYNGNPESVGYRIKYWRSDLQSSAVAQVVSDRLEREFTIEELEEWMEYELQMQAFNAVGAGPWSEVVRGRTRESVPSAAPENVSAEAVSSTQILLTWTSVPEQDQNGLILGYKILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALXAELTAQSSFKTVNSSSTSTMCELTHLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 31926 - protein, 390 aa, Homo sapiens
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKNTYKSIQMMRQYTSFHFASLEDVQAKVLEIPYKGKDLSMIVLLPNEIDGLQKLEEKLTAEKLMEWTSLQNMRETRVDLHLPRFKVEESYDLKDTLRTMGMVDIFNGDADLSGMTGSRGLVLSGVLHKAFVEVTEEGAEAAAATAVVGFGSSPTSTNEEFHCNHPFLFFIRQNKTNSILFYGRFSSP

SEQ ID NO: 31927 - protein, 1995 aa, Homo sapiens
MRTTEDFHKPSATLNSNTATKGRYIYLEAFLEGGAPWGFTLKGGLEHGEPLIISKVEEGGKADTLSSKLQAGDEVVHINEVTLSSSRKEAVSLVKGSYKTLRLVVRRDVCTDPGHADTGASNFVSPEHLTSGPQHRKAAWSGGVKLRLKHRSSEPAGRPHSWHTTKSGEKQPDASMMQISQGMIGPPWHQSYHSSSSTSDLSNYDHAYLRRSPDQCSSQGSMESLEPSGAYPPCHLSPAKSTGSIDQLSHFHNKRDSAYSSFSTSSSILEYPHPGISARERSGSMDNTSARGGLLEGMRQADIRYVKTVYDTRRGVSAEYEVNSSALLLQGREARASANGQGYDKWSNIPRGKGVPPPSWSQQCPSSLETATDNLPPKVGAPLPPARSDSYAAFRHRERPSSWSSLDQKRLCRPQANSLGSLKSPFIEEQLHTVLEKSPENSPPVKPKHNYTQKAQPGQPLLPTSIYAVPSLEPHFAQVPQPSVSSNGMLYPALAKESGYIAPQGACNKMATIDENGNQNGSGRPGFAFCQPLEHDLLSPVEKKPEATAKYVPSKVHFCSVPENEEDASLKRHLTPPQGNSPHSNERKSTHSNKPSSHPHSLKCPQAQAWQAGEDKRSSRLSEPWEGDFQEDHNANLWRRLEREGLGQSLSGNFGKTKSAFSSLQNIPESLRRHSSLELGRGTQEGYPGGRPTCAVNTKAEDPGRKAAPDLGSHLDRQVSYPRPEGRTGASASFNSTDPSPEEPPAPSHPHTSSLGRRGPGPGSASALQGFQYGKPHCSVLEKVSKFEQREQGSQRPSVGGSGFGHNYRPHRTVSTSSTSGNDFEETKAHIRFSESAEPLGNGEQHFKNGELKLEEASRQPCGQQLSGGASDSGRGPQRPDARLLRSQSTFQLSSEPEREPEWRDRPGSPESPLLDAPFSRAYRNSIKDAQSRVLGATSFRRRDLELGAPVASRSWRPRPSSAHVGLRSPEASASASPHTPRERHSVTPAEGDLARPVPPAARRGARRRLTPEQKKRSYSEPEKMNEVGIVEEAEPAPLGPQRNGMRFPESSVADRRRLFERDGKACSTLSLSGPELKQFQQSALADYIQRKTGKRPTSAAGCSLQEPGPLRERAQSAYLQPGPAALEGSGLASASSLSSLREPSLQPRREATLLPATVAETQQAPRDRSSSFAGGRRLGERRRGDLLSGANGGTRGTQRGDETPREPSSWGARAGKSMSAEDLLERSDVLAGPVHVRSRSSPATADKRQDVLLGQDSGFGLVKDPCYLAGPGSRSLSCSERGQEEMLLLFHHLTPRWGGSGCKAIGDSSVPSECPGTLDHQRQASRTPCPRPPLAGTQGLVTDTRAAPLTPIGTPLPSAIPSGYCSQDGQTGRQPLPPYTPAMMHRSNGHTLTQPPGPRGCEGDGPEHGVEEGTRKRVSLPQWPPPSRAKWAHAAREDSLPEESSAPDFANLKHYQKQQSLPSLCSTSDPDTPLGAPSTPGRISLRISESVLRDSPPPHEDYEDEVFVRDPHPKATSSPTFEPLPPPPPPPPSQETPVYSMDDFPPPPPHTVCEAQLDSEDPEGPRPSFNKLSKVTIARERHMPGAAHVVGSQTLASRLQTSIKGSEAESTPPSFMSVHAQLAGSLGGQPAPIQTQSLSHDPVSGTQGLEKKVSPDPQKSSEDIRTEALAKEIVHQDKSLADILDPDSRLKTTMDLMEGLFPRDVNLLKENSVKRKAIQRTVSSSGCEGKRNEDKEAVSMLVNCPAYYSVSAPKAELLNKIKEMPAEVNEEEEQADVNEKKAELIGSLTHKLETLQEAKGSLLTDIKLNNALGEEVEALISELCKPNEFDKYRMFIGDLDKVVNLLLSLSGRLARVENVLSGLGEDASNEERSSLYEKRKILAGQHEDARELKENLDRRERVVLGILANYLSEEQLQDYQHFVKMKSTLLIEQRKLDDKIKLGQEQVKCLLESLPSDFIPKAGALALPPNLTSEPIPAGGCTFSGIFPTLTSPL

SEQ ID NO: 31928 - protein, 1212 aa, Homo sapiens
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 31929 - protein, 418 aa, Homo sapiens
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 31930 - protein, 119 aa, Homo sapiens
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQLRSFALPL

SEQ ID NO: 31931 - DNA, 17 bp, Homo sapiens
gatcacatacctcattt

SEQ ID NO: 31932 - DNA, 17 bp, Homo sapiens
gatcctgaccctgaact

SEQ ID NO: 31933 - DNA, 17 bp, Homo sapiens
gatccgcgggaacgaca

SEQ ID NO: 31934 - DNA, 17 bp, Homo sapiens
gatcattcagacatttt

SEQ ID NO: 31935 - DNA, 17 bp, Homo sapiens
gatcagaaaaacaaaag

SEQ ID NO: 31936 - DNA, 17 bp, Homo sapiens
gatcctggaaggccaaa

SEQ ID NO: 31937 - DNA, 17 bp, Homo sapiens
gatcggcatgatgtagc

SEQ ID NO: 31938 - DNA, 17 bp, Homo sapiens
gatctggggtcccagtg

SEQ ID NO: 31939 - DNA, 17 bp, Homo sapiens
gatctaaagccctggtg

SEQ ID NO: 31940 - DNA, 17 bp, Homo sapiens
gatccatctgtgtttcc

SEQ ID NO: 31941 - DNA, 17 bp, Homo sapiens
gatcttcttagtctaac

SEQ ID NO: 31942 - DNA, 17 bp, Homo sapiens
gatcccattctaaatac

SEQ ID NO: 31943 - DNA, 17 bp, Homo sapiens
gatcaagcagagaaaat

SEQ ID NO: 31944 - DNA, 17 bp, Homo sapiens
gatctgctgcagaatct

SEQ ID NO: 31945 - DNA, 17 bp, Homo sapiens
gatccatacacaataaa

SEQ ID NO: 31946 - DNA, 17 bp, Homo sapiens
gatctaccacaaggtga

SEQ ID NO: 31947 - DNA, 17 bp, Homo sapiens
gatcaagcgcggggttg

SEQ ID NO: 31948 - DNA, 17 bp, Homo sapiens
gatcttcagaagccgtg

SEQ ID NO: 31949 - DNA, 17 bp, Homo sapiens
gatcgctgtgcctggca

SEQ ID NO: 31950 - DNA, 17 bp, Homo sapiens
gatccagattcgagctc

SEQ ID NO: 31951 - DNA, 17 bp, Homo sapiens
gatcgactgtaaatgag

SEQ ID NO: 31952 - DNA, 17 bp, Homo sapiens
gatctgtgtattactta

SEQ ID NO: 31953 - DNA, 17 bp, Homo sapiens
gatccttcagagaagcc

SEQ ID NO: 31954 - DNA, 17 bp, Homo sapiens
gatcttttctcttcatc

SEQ ID NO: 31955 - DNA, 17 bp, Homo sapiens
gatctgtgcaccctctt

SEQ ID NO: 31956 - DNA, 17 bp, Homo sapiens
gatctacacatcatttc

SEQ ID NO: 31957 - DNA, 17 bp, Homo sapiens
gatccaatgtaactcca

SEQ ID NO: 31958 - DNA, 17 bp, Homo sapiens
gatccgcccacagcctc

SEQ ID NO: 31959 - DNA, 17 bp, Homo sapiens
gatcggagttcaaaggt

SEQ ID NO: 31960 - DNA, 17 bp, Homo sapiens
gatctgctacaaaatat

SEQ ID NO: 31961 - DNA, 17 bp, Homo sapiens
gatcttgtacatgtatt

SEQ ID NO: 31962 - DNA, 17 bp, Homo sapiens
gatcacgtgtcgcatga

SEQ ID NO: 31963 - DNA, 17 bp, Homo sapiens
gatcctacttgttttgt

SEQ ID NO: 31964 - DNA, 17 bp, Homo sapiens
gatcaacagagattcat

SEQ ID NO: 31965 - DNA, 17 bp, Homo sapiens
gatctgtggctcatgtc

SEQ ID NO: 31966 - DNA, 17 bp, Homo sapiens
gatccacaaggcattag

SEQ ID NO: 31967 - DNA, 17 bp, Homo sapiens
gatcttaggcaaaatac

SEQ ID NO: 31968 - DNA, 17 bp, Homo sapiens
gatcatttaagcgtaga

SEQ ID NO: 31969 - DNA, 17 bp, Homo sapiens
gatcccataaaacaata

SEQ ID NO: 31970 - DNA, 17 bp, Homo sapiens
gatctgcaatgactgga

SEQ ID NO: 31971 - DNA, 17 bp, Homo sapiens
gatcaaacatgcatgga

SEQ ID NO: 31972 - DNA, 17 bp, Homo sapiens
gatctacttgtaatgaa

SEQ ID NO: 31973 - DNA, 17 bp, Homo sapiens
gatcacacttgtgggca

SEQ ID NO: 31974 - DNA, 17 bp, Homo sapiens
gatcaaaatctctatgt

SEQ ID NO: 31975 - DNA, 17 bp, Homo sapiens
gatccacttcggtcagt

SEQ ID NO: 31976 - DNA, 17 bp, Homo sapiens
gatccacggactacagt

SEQ ID NO: 31977 - DNA, 17 bp, Homo sapiens
gatcagaactgtttcca

SEQ ID NO: 31978 - DNA, 17 bp, Homo sapiens
gatctaaccagcacact

SEQ ID NO: 31979 - DNA, 17 bp, Homo sapiens
gatcagggaccccagag

SEQ ID NO: 31980 - DNA, 17 bp, Homo sapiens
gatcagggaccccggag

SEQ ID NO: 31981 - DNA, 17 bp, Homo sapiens
gatcatgtgcaggcttt

SEQ ID NO: 31982 - DNA, 17 bp, Homo sapiens
gatccagggaagtccag

SEQ ID NO: 31983 - DNA, 17 bp, Homo sapiens
gatcctaaggatgacaa

SEQ ID NO: 31984 - DNA, 17 bp, Homo sapiens
gatctggtctctgactt

SEQ ID NO: 31985 - DNA, 17 bp, Homo sapiens
gatcttcttggtgattt

SEQ ID NO: 31986 - DNA, 17 bp, Homo sapiens
gatcctcaggcaccccg

SEQ ID NO: 31987 - DNA, 17 bp, Homo sapiens
gatctgtataactgact

SEQ ID NO: 31988 - DNA, 17 bp, Homo sapiens
gatcccgtgaagaatgt

SEQ ID NO: 31989 - DNA, 17 bp, Homo sapiens
gatcctgtggagggaga

SEQ ID NO: 31990 - DNA, 17 bp, Homo sapiens
gatcatcacctacttca

SEQ ID NO: 31991 - DNA, 17 bp, Homo sapiens
gatcgtcatcatcaaga

SEQ ID NO: 31992 - DNA, 17 bp, Homo sapiens
gatcataacagtaggaa

SEQ ID NO: 31993 - DNA, 17 bp, Homo sapiens
gatcacaatgttgtttt

SEQ ID NO: 31994 - DNA, 17 bp, Homo sapiens
gatcacgttactgcatt

SEQ ID NO: 31995 - DNA, 17 bp, Homo sapiens
gatcaatgaataaataa

SEQ ID NO: 31996 - DNA, 17 bp, Homo sapiens
gatccccatgaaccttt

SEQ ID NO: 31997 - DNA, 17 bp, Homo sapiens
gatctaaaatgtcttct

SEQ ID NO: 31998 - DNA, 17 bp, Homo sapiens
gatccgcccacctggga

SEQ ID NO: 31999 - DNA, 17 bp, Homo sapiens
gatcgctaacgactcct

SEQ ID NO: 32000 - DNA, 17 bp, Homo sapiens
gatcatctatgcgtcag

SEQ ID NO: 32001 - DNA, 17 bp, Homo sapiens
gatcatttcaagggcaa

SEQ ID NO: 32002 - DNA, 17 bp, Homo sapiens
gatctaaaatagtataa

SEQ ID NO: 32003 - DNA, 5094 bp, Homo sapiens
atgcgcctgactcacatctgctgctgctgcctcctttaccagctggggttcctgtcgaatgggatcgtttcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctgatgggatttatacagctcaatgaggacttcatatttattgagccactcaatgatacaatggccataacaggtcacccacaccgtgtatataggcagaaaaggtccatggaggaaaaggtcacagagaagtcagctcttcacagtcattactgtggtatcatttcagataaaggaagacctaggtctagaaaaatagcagaaagtggaagagggaaacgatattcatacaaattacctcaagaatacaacatagagactgtagtggttgcagacccagcaatggtttcctatcatggagcagatgcagccaggagattcattctaaccatcttaaatatggtatttaaccttttccaacacaagagtctgggtgtgcaggtcaatcttcgtgtgataaagcttattctgctccatgaaactccaccagaactatatattgggcatcatggagaaaaaatgctagagagtttttgtaagtggcaacatgaagaatttggcaaaaagaatgatatacatttagagatgtcaacaaactggggggaagacatgacttcagtggatgcagctatacttataacaaggaaagatttctgtgtgcacaaagatgaaccatgtgatactgttggtatagcttacttgagtggaatgtgtagtgaaaagagaaaatgtattattgctgaagacaatggcttgaatcttgcttttacaattgctcatgaaatgggtcacaacatgggcattaaccatgacaatgaccacccatcgtgtgctgatggtcttcatatcatgtctggtgaatggattaaaggacagaatcttggtgacgtttcatggtctcgatgtagcaaggaagatttggaaagatttctcaggtcaaaggccagtaactgcttgctacaaacaaatccgcagagtgtcaattctgtgatggttccctccaagctgccagggatgacatacactgctgatgaacaatgccagatcctttttgggccattggcttctttttgtcaggagatgcagcatgttatttgcacaggattatggtgcaaggtagaaggtgagaaagaatgcagaaccaagctagacccaccaatggatggaactgactgtgaccttggtaagtggtgtaaggctggagaatgtaccagcaggacctcagcacctgaacatctggccggagagtggagcctgtggagtccttgtagccgaacctgcagtgctgggatcagcagtcgagagcgcaaatgtcctgggctagattctgaagcaagggattgtaatggtcccagaaaacaatacagaatatgtgagaatccaccttgtcctgcaggtttgcctggattcagagactggcaatgtcaggcttatagtgttagaacttcctccccaaagcatatacttcagtggcaagctgtcctggatgaagaaaaaccatgtgccttgttttgctctcctgttggaaaagaacagcctattcttctatcagaaaaagtgatggatggaacttcttgtggctatcagggattagatatctgtgcaaatggcaggtgccagaaagttggctgtgatggtttattagggtctcttgcaagagaagatcattgtggtgtatgcaatggcaatggaaaatcatgcaagatcattaaaggggattttaatcacaccagaggagcaggttatgtagaagtgctggtgatacctgctggagcaagaagaatcaaagttgtggaggaaaagccggcacatagctatttagctctccgagatgctggcaaacagtctattaatagtgactggaagattgaacactctggagccttcaatttggctggaactaccgttcattatgtaagacgaggcctctgggagaagatctctgccaaaggtcctactacagcacctttacatcttctggtgctcctgtttcaggatcagaattatggtcttcactatgaatacactatcccatcagaccctcttccagaaaaccagagctctaaagcacctgagcccctcttcatgtggacacacacaagctgggaagattgcgatgccacttgtggaggaggagaaaggaagacaacagtgtcctgcacaaaaatcatgagcaaaaatatcagcattgtggacaatgagaaatgcaaatacttaaccaagccagagccacagattcgaaagtgcaatgagcaaccatgtcaaacaaggtggatgatgacagaatggaccccttgttcacgaacttgtggaaaaggaatgcagagcagacaagtggcctgtacccaacaactgagcaatggaacactgattagagcccgagagagggactgcattgggcccaagcccgcctctgcccagcgctgtgagggccaggactgcatgaccgtgtgggaggcgggagtgtggtctgagtgttcagtcaagtgtggcaaaggcatacgtcatcggaccgttagatgtaccaacccaagaaagaagtgtgtcctctctaccagacccagggaggctgaagactgtgaggattattcaaaatgctatgtgtggcgaatgggtgactggtctaagtgctcaattacctgtggcaaaggaatgcagtcccgtgtaatccaatgcatgcataagatcacaggaagacatggaaatgaatgtttttcctcagaaaaacctgcagcatacaggccatgccatcttcaaccctgcaatgagaaaattaatgtaaataccataacatcacccagactggctgctctgactttcaagtgcctgggagatcagtggccagtgtactgccgagtgatacgtgaaaagaacctatgtcaggacatgcggtggtatcagcgctgctgtgaaacatgcagggacttctatgcccaaaagctgcagcagaagagttgacctctagcaggctggctggatcacagctcttggcaattacattatttataaacacacacactagcatgtttttcagaccaaatattatcagattacatataatttaatcaaattaatttatttttttgcctgccaaacatccaatgtggtgcttgttttggttacacaaacattttgatttatactatatggcttcataaataattttatatgaatgaattagttggatccagtaatataataaaaagaaaaaggaaaaaaatagatcattatacttaaaacaagttttcgttgtttgttagggctatctctaaggtgctactctctccccaccaataacattgaattatccagaatgtatactgacttagcataatagtttaggtgtatatgaagagaaactatttttgttttttggtgtcctgctgcagaattagcccattttctgtcacctgcaggagatgtgtaaacataatgaacctcatgctgttgaacaggtttttagagaatgtattatgaatttggttcagatttatagacatccataggaaaaattctgctgtaattataaccttattttgatatggaaaagaaaagtcaaaatagagactttgatcatgttcatgaacatgtacttgaacacaagtattgtaacaatgaaacactgtaatgatttacactgaatcacaattgcactgttgatatagtgtagagaaatcgttagaaatggtgacatcttacaaaaaatgtgtattattttaacatgttatcactagattttagctttttttaaatatttttaacaaagaaaacattgatccacccatttccctgtatctttttagcagatttattaaagagtatagtacttagcctcacgaatcataattagaaaatttactagtatttctcagccttttccctaggaacaaggaaaaacagaaagcatataatacggtggtcgtttcattgtgtttttcttccttttaaaaattaaaaagttttacaattatgtgaaacgttcaaaagccagcttaaaatttttcttgtgagaaaatattatacatgattcacatgatttcttagatttttcaataaaatatgtaaaacttcccactgagagacaattcttcatagacttgtcacatatccacatgtctgatgaacaaaggtactgtctacttttgttctggagtatcttctagaggatgtttatagagtgaactgccttggaagatagtatgtctcttgggagcaaagggcaaacatacttctcattataaaagtttcaggttccctaaaattggggtttctttactataagacaatccaatgtatgttctgaggtcacctggctctcttcatgtcaccctttgggaaatggggctcaacgagccagtacaggaaaagctgattccctggctactactatcgctgtgagtaataaagtcctttgtctttaatgaaaaa

SEQ ID NO: 32004 - DNA, 7333 bp, Homo sapiens
cccagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgtccacctctttattgaatcaaaaacacttcaaggaagcaaaggagaacacagctttaacagccccggcgtctttgtcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgcgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcttgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccacggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagagactgcacagacacaactcactactgtatgtttgtaaaacatcttaatttgtgttctctagaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaatttcagcttcactgacactgggttgagcactactgtatgtggagggtttggtgattgggaatggatgggggacagtgaggaggacacaccagcccattagttgttaatcatcaatcacatctgattgttgaaggttattaaattaaaagaaagatcatttgtaacatactctttgtatatatttattatatgaaaggtgcaatattttattttgtacagtatgtaataaagacatgggacatatatttttcttattaacaaaatttcatattaaattgcttcactttgtatttaaagttaaaagttactatttttcatttgctattgtactttcattgttgtcattcaattgacattcctgtgtactgtattttactactgtttttataacatgagagttaatgtttctgtttcatgatccttatgtaattcagaaataaatttactttgattattcagtggcatccttat

SEQ ID NO: 32005 - DNA, 3499 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaa

SEQ ID NO: 32006 - DNA, 3433 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaa

SEQ ID NO: 32007 - DNA, 1340 bp, Homo sapiens
ctcttcccattggctgagaagggtcatgaggatgaactgtgcagtcacctggcaggaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactacaaa

SEQ ID NO: 32008 - DNA, 1316 bp, Homo sapiens
ctcttcccattggctgagaagggtcatgaggatgaactgtgcagtcacctggcaggaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacaggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactacaaa

SEQ ID NO: 32009 - DNA, 1406 bp, Homo sapiens
ctcttcccattggctgagaagggtcatgaggatgaactgtgcagtcacctggcaggaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactacaaa

SEQ ID NO: 32010 - DNA, 2993 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 32011 - DNA, 2843 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 32012 - DNA, 2824 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 32013 - DNA, 6038 bp, Homo sapiens
taagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaaaaaaaaaaaaaaaaaaaaaaaaaaa

SEQ ID NO: 32014 - DNA, 6146 bp, Homo sapiens
taagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaaaaaaaaaaaaaaaaaaaaaaaaaaa

SEQ ID NO: 32015 - DNA, 1501 bp, Homo sapiens
ggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaaccaaaaaaaaaaaaaaaaaaa

SEQ ID NO: 32016 - DNA, 739 bp, Homo sapiens
taaagcaaaccccagcccacaccctggcaggcagccagggatgggtggatcaggaaggctcctggttgggcttttgcatcaggctcaggctgggcataaaggaggctcctgtgggctagagggaggcagacatggggaccatgaagacccaaagggatggccactccctggggcggtggtcactggtgctcctgctgctgggcctggtgatgcctctggccatcattgcccaggtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctagtgtgtgccctaccctggctcaggcttctgggctctgagaaataaactatgagagcaatttcaaaaaaaaaaaaaaaaaaaaaaaaa

SEQ ID NO: 32017 - DNA, 1699 bp, Homo sapiens
cttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctcaaaaaaaaaaaaaaaaaaaaaa

SEQ ID NO: 32018 - DNA, 5217 bp, Homo sapiens
gggtgcccgctccgccccccgggctatgtaaagcggccgggctcgggtcgtgccaccgctggactcccgtgtccctccgcgcaggcgggcggccccggagcgctggtgccggcagaggcggcgacggtggcgcccctcctcatcatgaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctagctgtgtgcagtctctcttacccttctgtgcccagctcagtcttccctagggctgggtgtattaggactggctttgtcccacagcttggggccatcggtcctgtctcccctctgctggccgggcacagctgtggtgaggttgggcagctgaacagtgttggctttcatgaggaggcagaaagcagaggctggcctcagactcatacagaaggtgggggttggctgggtacgagggatgtggagcacaaaagcctctcatcccccattaaccagggcaccaagcccacaggtgtccccagcccactggatcagaaagagttcagtaagaccggaagctcctggtatgggtttctcccagttctctagggaaggccacctgcaggtcactgaaacttcaagcaccagggaagatctaacatttgagtcccttccaggccatcagaggcctagtcagccacatgggaaacttccaagacctgactcaggcatcattccaccatggctaaggcaccagccggggaagacttgaaagaaaggggcaggagctcagatgaagagaaatcctaagttacctttctaggtcaaggcctgtccctggccatctctgaacttcagctagagcttcaagtctgtgcctggagctcctgggaaggctactcaccttgaacaccacgcttgacaggacagcatggtgcatgccgctgcatccgtgagcagtgtgtctcctgcatgcagaaagggagcagagaaggccaggggcttttgctaaaaatagtggccagaccagagctctggagccacctgtcccacctcaaatgggtctgggggtcaggaggcagggttttatctctgtctaccatctccctcgaacccacactgcaacaggaactgtgagagtctttgtaagtaaactgccctgtctaggtcagtacccacctgagctttggacgcacacagcttttagtacccacctgagctttggacacacacagcttctagtgatttctggggccccaccgtaaagtgagcatgctttctgaactcgcttctctgtgactgatgttaggctgggcccagaggcacagccggggcctgcctagcactcacatgctggacaggtctgggagaggcagagtgccccacctgccactaggctgggtgcccacagcccgcatgcagcagcttgctgcaccccaagtccaggtcgggctcagctctggctcacagactggagacaatgcagatgccagagcaaagggccaggaagggtcaaaacattttattctcttttttttttcttttttaataaagttaaacagtaaaacaaaaattcacaagctgcctccctgtccacccccgcctccctcccctgccctcggtcttcggcattggttccctttgctccaccccactcacagagacacagggcatccaactgagaaaacgaaactgctctaagcacacggagacgtgatgaagggaggaggtgaactgtttccacattcaagattaaactgagtgaatctgcattttctgggttctgggtggttgcccttcattagccaaattgaaaaaagaaattccctggaccagatgctgaaagagaaaagaggggttggtagttggctatggattttctaaggaagatcactttgctctgattatggaaaagtcttcaagggctgcttcaaactcaaacacagagagaaactctatgggtatcaaacagctcaggctgtttttgggtgcaagagggagcacgtgactgtattatacatgggtagcttctgacctcagcattatctatatagtacctttgctcttgcagagaagccttggtactaggcagttagagatgcctccctgaccctgcagagatgcggtggctaaaggtcccaaggcaaggggtgcctgggaaccttcctgtcttcatccttagcaacagccgagtggatagatgccctgctagatgagaattcagctgcccccgctcatgggcccctctgactcccaaagagctgcctaagaggcaatgagtgtgttggcttgtgatctgggaactcccaagaacagcaggcccacctaccttcaaagctgaagccgccaggaccgccaaagaatgccttgaagatattgtttggatcaaaatctgtagagcagggcaagtaacatggaagggaagaaaaggtgaaaaattagaaatgttcgaagagaactgatgacactgagaacagatctccaaagctttcctggagagtctcactcccctcctttcccaacacttcagactgcaagtgagcaaacctgccccatcccgtgcaaaacatgctacctgatcccactcctaggacatgttcccttctccttccaactgctgccccaaaggaagctttctctgcttcagcttgcttcattgggctgttttctcaacaaatggaatgccatttgcacttacacaagactttccccatactctgtctccctataatgctggagcggctactaaaaaggataaaatgtatcacttaaatgttaccaaaaataaatataagagcaagatct

SEQ ID NO: 32019 - DNA, 4201 bp, Homo sapiens
agaaagctggaacccggccggagtagctctgagcgccggctgtgaggaaggaggttctgggcaagctatagccatggctgtggctgtagccatggcgggagccttaatcgggtcggagccaggccccgcggaagaacttgccaaactcgagtacctgtctttggtgtcaaaggtttgcactgagctggacaatcacttggggatcaacgacaaggaccttgctgaatttgtgatcagtcttgctgagaaaaataccacctttgatacttttaaggcttctctcgtcaaaaatggtgcagaatttacggattctcttattagtaacttgctgcgtctcatacaaaccatgcggcctccagcgaagccttccactagcaaagatccagttgttaaacctaaaacagaaaaagaaaagctgaaggaactcttcccagtcctttgccaaccggacaacccttctgttcggaccatgttggatgaagatgatgtgaaagttgctgtggatgtcctgaaagaactggaagctttaatgcccagcgcagcaggccaggagaagcaaagagatgctgaacaccgggacaggacaaagaagaagaagcggagtcgaagccgagatcgaaaccgagatcgagacagagatagggaacgaaaccgagatagagaccacaagcggagacaccgatcccgctctcgatcacgttccaggacccgggagaggaataaagtgaagtctagatatcggtccaggagcaggagtcagagtccccccaaagaccggaaggaccgggacaaatatggagagcggaatctggatagatggcgggataagcatgtggaccgccctcctccagaagagcccaccattggtgacatttataatggcaaagttaccagcatcatgcagtttggttgctttgtgcagctggaaggactaaggaagcggtgggaaggcctggtgcacatctctgagctccggcgggagggtcgtgtggccaatgtagctgatgtcgtgagcaaaggccagagggtcaaagtcaaagtgctgtccttcactgggaccaagaccagcctgagcatgaaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacagatgattgctgccaatgtcctttccaaagaagaatttccagactttgatgaagagactggcattctccctaaggtggatgatgaagaagatgaggaccttgagattgaattggttgaggaagagcctccattcctgagagggcacactaagcaaagcatggacatgagccccattaaaattgtcaagaacccagacggctccctctcccaagcagcaatgatgcagagtgccttggccaaagaaaggcgggaactcaaacaggcccagcgggaagctgagatggattctattcccatgggactcaacaaacactgggttgaccctctgcctgatgcggaaggcagacagattgctgccaacatgaggggtattgggatgatgcccaatgatattcctgagtggaagaagcatgcctttgggggcaacaaagcctcttacggaaaaaagacccagatgtcaatccttgagcagagggagagcctgcccatctacaaactgaaggagcaattggtccaggccgtccatgacaatcagatcctgattgtcattggtgagacaggatctggaaagacaacacagatcacccagtacctggcggaggcaggctacacttccaggggcaagattgggtgtacccagcccagaagagtggcagctatgtcggtggccaaaagagtgtcagaggagtttggttgttgcttaggccaagaggtgggctacaccattcgatttgaggactgcactagccctgaaacagtcatcaagtacatgacagatgggatgttgcttagagagtgcttgattgaccctgacctcactcagtacgcgatcatcatgttggacgaggcacatgagaggacaattcacactgatgtgctctttggattgttgaaaaagacagttcagaaacggcaggacatgaagctgattgtcacctcagccaccttggatgcagtgaagttttctcaatacttctatgaagctcccattttcaccatcccaggtcgaacatatccagtggaaatactgtacacaaaggaacctgagacagattatctggatgccagcctgattactgttatgcagattcatttaacagaaccaccaggtgatatcctggtcttcctgactggtcaggaagaaattgatactgcttgtgagatcctgtatgaaagaatgaaatccctgggacctgatgttccagagttaattatcctcccagtgtactctgctcttcccagtgagatgcagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaagg

SEQ ID NO: 32020 - DNA, 3097 bp, Homo sapiens
cccccgagggacatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccaggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaagggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcaccc

SEQ ID NO: 32021 - DNA, 3055 bp, Homo sapiens
gctctaaacaacctcatcaaaactactttctggtcagagagaagcaataattattattaacatttattaacgatcaataaacttgatcgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccaggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaagggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcaccc

SEQ ID NO: 32022 - DNA, 6456 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatccgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgaacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaact

SEQ ID NO: 32023 - DNA, 2777 bp, Homo sapiens
cgccgctcctcgcggcctccgcgtcttccttccgggtcgcgctaggccgggcttgcggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgt

SEQ ID NO: 32024 - DNA, 1566 bp, Homo sapiens
atggcccaaggcttccatcgttcctctgtccctgaatcaactctgtccagacccgagctttggatctaccaaggcctcaagccaccaaggaaaatgaagggcctctaccaggctgctggccggattcttgttactctggggatcctcagtgtatgctctggagttattgctttctttcctgtcttttcttacaagccttggttcacaggatggagtgttcgaattgcttgtcctatctggaatggagctttggccatcacaactggtgtgcttctactgttggcttacagagagtggacccagaggtacctgggggaagctactttcacctttgtgattctgagcattatgggatgtccacttcattttgcaatagccttggaatctgctctcctgggcccatattgcttctattcattttcagggattgcagggactaattaccttggctatgcagttacctttccttatccatatgcaaaattcccattagcctgtgtggacccaccacactacgaagagtaccacctgacacttcaagccctagacctgtgcctaagctttaccctactctgtacatccttgacagtgttcatcaaactttctgcaagacttatccagaatggacacataaacatgcaactccctgctgggaacccaaaccctttttcaccataaaaggtaaaatggtctggggatagaaaaggcctgggaccagaatataaaagcacacagattaatagaattataaaatttaagatgtttaaacaagctttatataaggtagttgaactcctttacctaaatgtcttattaaaatgggtactgcatctgactgggatgtttcccctttctagtactatgaagctgaaggcatgtaaatctgctcttttaggaaatgttaattaaacatgctaaatgggaactagtaaaatcacctaagcccacaaagtatagggtagtacctggagtgctagtctagatgaattagtcactgcatagccctttgtgtggagcattcatcggggctgaatggcaaaagactgtgagtgtttttctataacaacaactgaactagagaatttccacttgatggggcatttactgccttgttatagaatattaactgaagctacctctatgctaatggaaataatggtgcccaaaagagttccatgataaaataaaaatggtttacataaaaaaaaaactcacacacatggaatcaagtaatatttgacaagggtgtcaggaatgcataatgaggaataatagcctttttaataaatggtgttaggaaaactggatatctacatgcaaaagaatgaactacgaccccgatctgaggccagtcacagaaattaacttaaaatggattaaagatttaaatgtaagacctaaagctgtaaaactactgaaagaaaacatagggataaagctccattgacatttgtcttagcactgctttttttggatatgacatgaaaagcacatgctaccaaagcagaaataaacagtgggactacatcaaactaaaaagcttctgcacagcaaagaaaacaatca

SEQ ID NO: 32025 - DNA, 1566 bp, Homo sapiens; identical to SEQ ID NO: 32024

SEQ ID NO: 32026 - DNA, 4705 bp, Homo sapiens
gctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggagggcaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggc

SEQ ID NO: 32027 - DNA, 675 bp, Homo sapiens
gcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggctt

SEQ ID NO: 32028 - DNA, 2653 bp, Homo sapiens
cttcaaagaggcagctgcagtggagaatcatgttaagctcggctactgcggagagcccaaggtagcccaataatggattttgatgagcgtggtccctgctcctctaacatgtatttgccaagttgtacttactacgtctcgggtccagatttctccagcctcccttcttttctgccccagaccccgtcttcgcgcccaatgacatactcctactcctccaacctgccccaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagagctgcgggctgggtgtggtctccactggggattgggcccctgccagaccccctggagactaaccccaccacaccctccctctactgggagcctacccacccccaggacccctgagtaaaaaagctgtgtgctctccaagcccagttcagcttggggacaggggcaggaggaaggggtaggattactaggtgcccagaatgaggctgctttccaaagccaatgtgaacagcggctggacttggaggtagctttgaggtggaagagggctgcaaatccttgtgggaaaagaaatctatgattccaggtggcatcagtgtctttccactcctcctagccacccaccacactgatccagccctgagttcctagccaccgcctcctacagcccacctggcttttctttctaccaaatgagggtcttggttccagcctgccactcaggcccaaagcctcgacacagagtggactgttccctgaggtgggagatgtggaaaagccaagaggctgcagccaggccactggcccctgagatctctgcaggaaatggctgtggagtgtggcagtttggcaaactctccaccacacgtaatgaaacttggatttgctcagtgtctggctgcagagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaattttcttttctttctttctctttttcttttttcttttgccattagttgatttcctttagggtgttggagggggtggaaaaggtattgagaatggtctttttaatctcttgcaacatttggaaagagttagggaaatgctcagaggcagtcggcctggccggcctggggatctcatctgggaaagccaggcaccctcccattgaatctcctttgcctccctgtgttaagaaatgtctgttggctccatttgtactgggagtgttggcctgtcctcaattctggttcttacccaccgtgtgtgttgcagcacttatacaggcaactgggcacaaggaaaataaagacggtggaaatttga

SEQ ID NO: 32029 - DNA, 5035 bp, Homo sapiens
gcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaaaaaaaaaaaaaaaaaaaaaaaaaaaa

SEQ ID NO: 32030 - DNA, 5005 bp, Homo sapiens
gcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaaaaaaaaaaaaaaaaaaaaaaaaaaaa

SEQ ID NO: 32031 - DNA, 5009 bp, Homo sapiens
agtgggtgcggtcacgtgggccggcggtccagggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttggaaaagatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttc

SEQ ID NO: 32032 - DNA, 5003 bp, Homo sapiens
agtgggtgcggtcacgtgggccggcggtccagggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttc

SEQ ID NO: 32033 - DNA, 2102 bp, Homo sapiens
acacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtttcaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 32034 - DNA, 4300 bp, Homo sapiens
caacccgcgaggccccacactttctgcgccagctgggagtgcgcgccctgcagagccagtgggtgggcggttctagctcttcccaccctcactgcgggcctctgctgtcacacgcccggggtggcgaaacggtcgccacctgagtctccattctgctgcagtggcccctgcgttaaagctctctcgtggtgcggctgccgaggctgcggtagctcctgcgcccccgtgctggtggcgcagcctctgcttgctgccgacctggcggaagggtgcgggagcgcacgctacgggcagcgtcggtctgcgtccttcctcctcctattccgacccccgcatcccacgcccccgcctcgctctacgcctcctccctggctgcaggcagaccgcttcacacagccgcagtgccctgtgtgtggacagcctgtgggagactcgcacgcccacactcaccccgcctggctgcacccctgcccagcatgtcggcgctcgagtggtacgcccacaagtctctaggcgatggtatcttctggattcaagaacgtttctacgagtcgggcaaccgtgccaacatctggctggtgcgcggctccgagcaggacgtggtgatcgatacaggcctggggctgcgcagcctcccggagtacctgtactcctccggcctcttgcaggaccgagaggccaaagaggacgcggcgcgccggccactgcttgccgtggccacccacgtgcacttcgaccactccggcggcctctaccagttcgaccgcgtggcagtgcaccacgccgaggccgaggcgctggctcgcggggacaactttgagaccgtgacctggctttccgatagcgaggtggtgcgggcgcccagccccggctggagggccagacagttccgggtacaggcggtgcagcccaccctcatcctgcaggatggggatgtgatcaaccttggtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgctgaaaggctttttcgattggcttctaactatatttcaaaagctgggatatgtcacaaagtttctacttttgccatgcgatctcttgcaagtttagctctacgtgtaacaaattctaggacctcgccctagtatctatactgataatatattttgattaattatatacattaattcattctgtgctatttaactgattaatagtgagcatttcatgaagtgcttttataccactattatatatcagagaaagattgagaatgaataagccaaaaagaaaattgttagtttaaattgttttctttcttccaagaaagaagccacttaaataagcttatactttgccaaagctgtcatcttgtaatatatgctctagaaatgacataaaggtttatggggaagcaaagagagattttgtggcaagagaactgcccttgcctctgtttttcttgttttattcccttgatgacctagggaaaaaaaggcatgtagagtattatgtttatactttaaacttgatatttttagtgtattatttaaagataaaggttcttgggtttaaaatacattagaacttaatgcagacatataaagtaacattgagaatgacaactaaaacattccattgttatggtcctgaattttttatgcttcatttcatgtatttattctttgtataattatagcatacatgttatgtaatataacttatgaaaagtacagtgaattttgctttattgcaaagctttaaatataaatttcagagtgcttcagtaaaaagctactatatattgttgtttgttattgtgtaggtaatattttcaattatgaaagtgaaatgcaaatgtctgttatctaactacaaattgtcagatttcttaaaaggacactgtcaggcaaatttgaaaatatacacattgagaataattttttattattatatcctattttaatattaacagctattatgaacaaaatttttcctgttaaatagcgacttcagtattgtgttatgttttacagcgttaaaacaactatgaagatctgcagctattcttttacttaacatgcatatgtactacagagggatttttaaattaattgcaaaatgtgcattagctattgacttagagtgaattgccttttgtatcctgattcacaacacctattcctgttcagtattctttgtcttgaatagagaagtctatgttcgtaaagtcatataaaaggttataccactatttagtaaaaagttttagtttggtgctgttaataataatttgctaaaaggccttttagaatatttcataaagggttttaaacagttttttcccactgcctttttattattgacatatctaaaaccaaactgaaatcgctttggaaatcagattttttaatgttaggaagatccagcaattttggtttctgaaaaattacaaaacttttctaccctacagatgcccaggttctttagttttttattcattcaactcacacacacataaacatatacatacacaaacacaatcccacatgcaaacacacacagccacatatatacatgtgtagcacagcgctaaacactgtggaggctaaaaaaagtcaaagacaacattataactaaaagtcgaaagcacacaaaatataaataatagtgtatgcaagttaatgtacattatacatgcgtgtaagggacataaatggaggggtgtgaactttggttaggcaaagtttactggaggaggggtttttgagtcaaatttggaaggatgaacttgttagatagtcagagttggaaacaaaacaatccaagaatagggatataagcattgctagtctagaatagtctattccttgtgaaaatataaatttaattttcaggaatccagtatattccaaacatcacatatttagcatgagaaaaattgatttgtgattgtgtatatgagtcattgttaatgggagacaagctgaactgccacatgccaccaaatgaacctttacttcaatcaaaaaggagggtatgattggttcaattatattaacagaatatcatgggcatttctctatgatggtcattcaaggtagtaggtctctttcaactgagtgcaacattgagaataatgatttggttcagggcaactacaaataatcacttactaagccttaaataaagccattatttttatatcaatagcacaaaggaaaaccaaaagtccttaaccactgaccatttttatcatattttaggcctttttttaaaaaatcagggtatagtaggcactaagttttattaggaaatatttaaacctgctgaaggatttatttataaaaagtgcaatttttcaaaacacattattattttttaatttcccaattttttcagtttttcaaattgtaccacaacatagaactgtgatattttgctattacttcaatgtgaataaataaggtaaagtatatcatttattgagtgcccatgctgtacatttaaaatatgcattatttaatttaatcttactcccagcaccaaaaggtaattgaccagcctcaacacaattttggacaaagctagtaactgaacacaggtctgtctgccccacacttctctttctcttgtaactgcacaatagcagaaaattggcaagatgtatttttactttccaagatgccgtgtgtgccaagaataaatgaaatgatgttaaagcataataataacatatctttaaaaagcttttcaaaatatattttcaccctgacagtgacccttgtaacttaaatgatttttggaaatattagtatgtaagtataattcaaagttgtcaaaatgtaagacatttagaagtaatttttattatttatattgttaatacttaatcactggaaattcattttccttactcgatgttttctttcaactgagaagcctaaaacaaacaaaaaccttgtgtgttatcctgatatagttgactaaatgtatttgttcttatatggatagtaatatgaatgtgacatgcaccaattgtcctattataattttcagataagtgtaactaagcacttgtgtaataaatattagtcattttatttcaaaaaaaaaaaaaaaaaaaaaa

SEQ ID NO: 32035 - DNA, 1421 bp, Homo sapiens
tgtagtcactgccctggaggacgtgttccaggccctgggctttgagagctgcgagaggagggaggtcccggtccagggcttcctcgaggaactggcttggttccaggagcagctggatgcccacgggcgccctgtggggtgtgccttagtggccttgatgcccccagagggcagctgaggcagccacagcagctggtccgggagctgagcggctgccgggccctgcggggctgccccaaagtcttcctgctgctctcaagtggtcctgggtcctccctggagcccggagccttccttgctggcctgagagagctgtgtggccgctctcctcactggtccctggtgcagctgctgacgaagctcttccgcagggtggctgaagagtccgcagggggcacctgctgccccgtccttcggagctccttgaggggggcactgtgcctgggaggcgtggagccctggaggcctgagccggcccccggtcccagcacacagtatgacctgtccaaggccagggctgccctcctcctggctgtgatccaaggccggcctggggcccagcatgacgtggaggcgctggggggcctgtgctgggccctgggctttgagaccaccgtgagaacggaccctacagcccaggctttccaggaggagctggcccagttccgggagcaactggacacctgcaggggccctgtgagctgtgcccttgtggccctgatggcccatgggggaccacggggtcagctgctgggggctgacgggcaagaggtgcagcccgaggcactcatgcaggagctgagccgctgccaggtgctgcagggccgccccaagatcttcctgttgcaggcctgccgtgggggaaacagggatgctggtgtggggcccacagctctcccctggtactggagctggctgcgggcacctccatctgtcccctcccatgcagatgtcctgcagatctacgctgaggcccaaggcagctcctgcaggggcacccctccagggagctctgaccaagcagacatcctgacggtctactcagccgcagagggctatgtggcctatcgcgatgacaagggctcagactttatccagacactggtggaggtcctcagagccaaccccgggagagaccttctggagctgctgactgaggtcaacaggcgggtgtgcgagcaggaggtgctgggccccgactgcgatgaactccgcaaggcctgcctggagatccgcagctcgctccggcgccggctctgcctccaggcctgagggtgcggcggccacgggggcgctgctgagacggtggccagatcccagcgccattcttgcctccatccaccccccatccccccggtttcctcatctgagagcgaggcgtggcagcgtgggggtggccgtgcaataaatatctgccgtga

SEQ ID NO: 32036 - DNA, 1421 bp, Homo sapiens
tgtagtcactgccctggaggacgtgttccaggccctgggctttgagagctgcgagaggagggaggtcccggtccagggcttcctcgaggaactggcttggttccaggagcagctggatgcccacgggcgccctgtggggtgtgccttagtggccttgatgcccccagagggcagctgaggcagccacagcagctggtccgggagctgagcggctgccgggccctgcggggctgccccaaagtcttcctgctgctctcaagtggtcctgggtcctccctggagcccggagccttccttgctggcctgagagagctgtgtggccgctctcctcactggtccctggtgcagctgctgacggagctcttccgcagggtggctgaagagtccgcagggggcacctgctgccccgtccttcggagctccttgaggggggcactgtgcctgggaggcgtggagccctggaggcctgagccggcccccggtcccagcacacagtatgacctgtccaaggccagggctgccctcctcctggctgtgatccaaggccggcctggggcccagcatgacgtggaggcgctggggggcctgtgctgggccctgggctttgagaccaccgtgagaacggaccctacagcccaggctttccaggaggagctggcccagttccgggagcaactggacacctgcaggggccctgtgagctgtgcccttgtggccctgatggcccatgggggaccacggggtcagctgctgggggctgacgggcaagaggtgcagcccgaggcactcatgcaggagctgagccgctgccaggtgctgcagggccgccccaagatcttcctgttgcaggcctgccgtgggggaaacagggatgctggtgtggggcccacagctctcccctggtactggagctggctgcgggcacctccatctgtcccctcccatgcagatgtcctgcagatctacgctgaggcccaaggcagctcctgcaggggcacccctccagggagctctgaccaagcagacatcctgacggtctactcagccgcagagggctatgtggcctatcgcgatgacaagggctcagactttatccagacactggtggaggtcctcagagccaaccccgggagagaccttctggagctgctgactgaggtcaacaggcgggtgtgcgagcaggaggtgctgggccccgactgcgatgaactccgcaaggcctgcctggagatccgcagctcgctccggcgccggctctgcctccaggcctgagggtgcggcggccacgggggcgctgctgagacggtggccagatcccagcgccattcttgcctccatccaccccccatccccccggtttcctcatctgagagcgaggcgtggcagcgtgggggtggccgtgcaataaatatctgccgtga

SEQ ID NO: 32037 - DNA, 4709 bp, Homo sapiens
ctccccagtaccctcacctgcgcgggatcgctgcgggaaaccagggggagcttcggcagggcctgcagagaggacaagcgaagttaagagcctagtgtacttgccgctgggagctgggctaggcccccaacctttgccctgaagatgctggcagagcaggatgttgtaacgggaaatgtcagaaatactgcaagcaaactgaaaacaacccatccatgtaggaaagaataacacggactacacgttattcaaggacacggaaaagccaacaccatggtagcattaatgaaagtttaccaagaggaagatgaagcctaccaggaattagttaccgtggcaaccacgttcttccagtacttattgcggccatttagggctatgcgagaagttgcaactttataagtccttggatgaggatgacctaggtcctagaagggtagttgccctggagaaagaagctgaagaatggaccagacgggctggagaagctgtcgtctctattcaagatatcacagtgaattattttaaggagacagtaaaagcattagcaggaatgcaaaaagaaatggaacaggatgtgaagagacttggccaggctgcctgggccacagcaattcccaggttggaaaaacttaagctaatgctagctcaagagactctgcaactcatgagagcgaaagaattgtatttaaattgcaaaagagctgaaattcagggaaagatggaagatcttccagaacaagaaaaaaatataaatgttgtagatgaattagaaatacaattttatgaaattcagttagaactatatgaagttaaatttgagatattaaaaaacaaagaaatactgcttactacacagttggactctcttgaaagacttataaaagaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaaggatcagtgcaaagaaaatcattggctcagattgcaacaggctgaagaaagcataagatattctcgtcagcatcacagtattcagatgaaaagagacaagataaaaaggagcaaaagaaaaaagaatgggtcaaccaagaacgtcaaacactccaacgattgagagcatttaaagatgtaagttctataaacaatcacctcatctacacttctggggaaataaatgaagaccgctctaaagaggaaagtattaagaacaggtcattcagaacatgaaacatttaaaaaataacattatttctggtatatcaataaaaagcaacaacaaaaatagaatatcagtgattcaaaacccatgatataaaataactgctgtttttaacatcacaacacgcttgggttcctgctctgcactcttcactgagtagtccttactggcactggtggtttagattggcagggaaaactgaaaactgttcaactcccttgactttagctggcatttcctctcatttgtaataaacaattctttaaaatgttatccaggcagcattgtgatataagtgtagtgaaagtgcccagttaaaagtaaaatgtgttgttgtttttttttgatatctacaactttcttttttctttttttttaaagtatatacttaagaggatgatgttatttttttatgccctctgttccaggcctacatttgtatttcctccacaaaatgatcctcagtctgtaatttttgttctatttgactttattattagagataaattcctttaattaaaaaaaagctactatgaaggttgaaaaaataattttttggttttatttttaattgacacataattgtacatatttatgaggtatagtgtgatattttgaggtatataatatggaatgatcaaatcagggtaattagcgtatctatcacctcaaacatttatctacaggtaaataggttttttaaaataaagtaaatagggagtctggcacagtggctcatgcctataatcccagcactttgggaggctgaggcgggcggattgcttgagaccatgaatttgagaccaggctgggcaacatggtgaaaccccagctctcctaaaaatacaaaaattagctggacatggtggtgcatgcctgtagtcccagctacttgggaggaaaaataccaattgtgcacatatttttgtaaaattatacataaacactttattttttatgtcattctaaataattttttgtatgtttctatttccaaacgttgtttggtaatatatagaaatatgattgattttgtttattgagtttgcatataaccacattactaaactcgcatattgagcattttaataggttattttgaatacttttacatagactgttgtctgaaaatagaaacaggtttatttcttcctttctgatgtggatgtcactgatttttttccctacattactgatctggctaggactatcagtataaagttgaatataagtggtaaaagatctgacttcttgccttggacccagtttttaaatcagttggagagtcaccattaagtgtaatttagtggtagttttgtttgttttttttttgtttgttttgtagatgccctctatcaggataagttcccttttctcattttgctgagagtttttataaagaatagctattgaattttgtcaaatgcttttgctgcatctgctgaaatgacacgtttattcttcatctacctaataatgttgcaatttatatctgttgagctttgaatgttgaaccagccttgcattcatggtataaatcacttgtttgtaaagtattgtttttaaatattgctagatttgatatcttagtattgtatttttatatttgtcttcatgtgtttttgttttctcataagtgtctgtacccccctttttttttctttaaagagaaataatgagagagattgtctctcttgaagttctcagtgcctgtgcattgctgccactacacagctagtatcatgacagcagcttcagaaccagagctggcttccaggcaaggctgggtggggaagaaagagaaaaacaaaagaattatttctctatgccgagaccagctcggtcagggagaccctaacctagcggtgctagaggaattaaagacatagacacagaaatatagaggtgtgaagtgggaaatcaggggtctcacagccttcagagctcagccacaaacagagatttacccacgtatttattaacagcaagccagtcattagcattgtttctatagatattaaattaactaaaagtatcccttatgggaaacgaagggatgggccgaattaaaggaataggttgggctagttaactgcagcaggagcatgtccttaaggcacagatcactcatgctattgtttgtggtttaagaatgcctttaagcggttttccaccccgggcaggccaggtgttctttgccctcattccagtaaacccacaaccttccagtatgggtgttagggccattatgaacatgttacagtgctgcagagattttatttatggccagtttatggccagattttggggggcctgctcccaacactctacatatgctccatcttgcagaggcttcattcttggttctctagctaaaaacagtagaaattttgcacacctgggttagaaaaaaaaaaaatagccattaaacccacccctgttacaggtcactattggtattttgattttgccttcaatccatctgttattgtttacttttaagagtccttgatagttgctttttatgtccagagttttaatttcagtcagaaagagaaataggccttggtgagcatgctttgtcttggctggtgccagaagtcagtactcaaatatttttaaaataatttttagttgaataacaagttagacctgtgtttagctttctcattgttttcctaaaaatagaagaaaaggttttaaatactttaaccacgaaataatttaaagcaggtttaaaataaactccttcattttgcctgttctattactctgttctcacactgctaataaagacatacccaagactggtaatttataaagtaaagaggtttaattgactcacagttccacatggctggggaggcctcccaatcatggcagaaggtgaatgaggagcaaagtcacatcttacatggtggcaggcaagagagagagcatgtgtgcaggggaattcccctttataaaaccatccaatctcatgagacttatgcagtctcatgggagcagcatgagaaagactcacctccgtgattcagttacctcccactgtgtccctgccacaacatgtgggaattgtgggaactaaaaatcaagatgagatttgggtaggaacacagtcaaaccatatctcctatatacattcacactagcattttagttttagaactagttctatgttactatctgaattaatttttccacaattttgtaaggaaaaataatgcgttctttgaatttcatgtgtaaatgatatttttagttttgtgtcattttgtcaaataaattctgaaaatctttgtattgacagtgtgttatctctgcataaccatatatgtataagagtgctcaataaaaagaataaagag

SEQ ID NO: 32038 - DNA, 1997 bp, Homo sapiens
ctccccagtaccctcacctgcgcgggatcgctgcgggaaaccagcgggagcttcggcagggcctgcagagaggacaagcgaagttagagcctagtgtacttgccgctgggagctgggctaggcccccaacctttgccctgaagatgctggcagagcaggatgttgtaacgggaaatgccagaaatactgcaagcaaaactgaaaacaacccatccatgtaggaaagaataacacggactacacgttattcaaggacaccgaaaagccaacaccatggtagcattaatgaaagtttaccaagaggaagatgaagcctaccaggaattagttaccgtggcaaccacgttcttccagtacttactgcagccatttagggctatgcgagaagttgcaactttataagtccttggatgaggatgacctaggtcctagaagggtagttgccctggagaaagaagctgaagaatggaccagacgggctggagaagctgtcgtctctattcaagatatcacagtgaattattttaaggagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagagttatgtttaaatcacaaaagagctgaaattcagggaaagatggaagatcttccagaacaagaaaaaaatataaatgttgtagatgaattagcaatacaattttatgaaattcagttagaactatatgaagttaaatttgagatattaaaaaacaaagaaatactgcttactacacagttggactctcttgaaagacttataaaagaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaagagacggggtttcgccatgtcggctaggctcgtcttgaactcctgacctcaagtgatccgcccaccttggcctcccaaagtcctgggattacaggtgtgagccaccacccccggaccacaggatcagtgcgaagaaaatcattggctcagattgcaacaggctgaagaaagcataagatattctcgtcagcatcacagtattcagatgaaaagagacaagataaaaaggagcaaaagaaaaaagaatggatcaaccaagaacgtcaaacactccaacaattgagagcatttaaagatgtaagttttataaacaatcacctcatctacacttctggggaaataaatgaagaccgctctaaagaggaaagtattaagaacaggtcattcagaacatgtaacatttaaaaaataacattatttctggtatatcaataaaaagcaacaacaaaaatagaatatcagtgattcaaaacccatgatataaaataactgctgtttttgacatcacaacacgcttgggttcctgctctgcactcttcactgagtagtccttactggcactggtggtttagattggcagggaaaactgaaaactgttcaactcccttgactttagctggcatttcctctcatttgtaataaacaattctttaaaatgttatccaggcagcattgtgatataagtgtagtgaaagtgcccagttaaaagtaaaatgtgttgtttttttttttgatatctacaactttcttttttcttttaaagtatatacttaagaggatgatgttatttttttatgccctctgttccaggcctacatttgtatttcctccacaaaatgatcctcagtctgtaatttttgttctatttgactttattattagagataaattcctttaattaaaaaaaagctactatgaaggttg

SEQ ID NO: 32039 - DNA, 4695 bp, Homo sapiens
ctccccagtaccctcacctgcgcgggatcgctgcgggaaaccagcgggagcttcggcagggcctgcagagaggacaagcgaagttagagcctagtgtacttgccgctgggagctgggctaggcccccaacctttgccctgaagatgctggcagagcaggatgttgtaacgggaaatgccagaaatactgcaagcaaaactgaaaacaacccatccatgtaggaaagaataacacggactacacgttattcaaggacaccgaaaagccaacaccatggtagcattaatgaaagtttaccaagaggaagatgaagcctaccaggaattagttaccgtggcaaccacgttcttccagtacttactgcagccatttagggctatgcgagaagttgcaactttataagtccttggatgaggatgacctaggtcctagaagggtagttgccctggagaaagaagctgaagaatggaccagacgggctggagaagctgtcgtctctattcaagatatcacagtgaattattttaaggagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagagttatgtttaaatcacaaaagagctgaaattcagggaaagatggaagatcttccagaacaagaaaaaaatataaatgttgtagatgaattagcaatacaattttatgaaattcagttagaactatatgaagttaaatttgagatattaaaaaacaaagaaatactgcttactacacagttggactctcttgaaagacttataaaagaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaaggatcagtgcgaagaaaatcattggctcagattgcaacaggctgaagaaagcataagatattctcgtcagcatcacagtattcagatgaaaagagacaagataaaaaggagcaaaagaaaaaagaatggatcaaccaagaacgtcaaacactccaacaattgagagcatttaaagatgtaagttttataaacaatcacctcatctacacttctggggaaataaatgaagaccgctctaaagaggaaagtattaagaacaggtcattcagaacatgtaacatttaaaaaataacattatttctggtatatcaataaaaagcaacaacaaaaatagaatatcagtgattcaaaacccatgatataaaataactgctgtttttgacatcacaacacgcttgggttcctgctctgcactcttcactgagtagtccttactggcactggtggtttagattggcagggaaaactgaaaactgttcaactcccttgactttagctggcatttcctctcatttgtaataaacaattctttaaaatgttatccaggcagcattgtgatataagtgtagtgaaagtgcccagttaaaagtaaaatgtgttgtttttttttttgatatctacaactttcttttttcttttaaagtatatacttaagaggatgatgttatttttttatgccctctgttccaggcctacatttgtatttcctccacaaaatgatcctcagtctgtaatttttgttctatttgactttattattagagataaattcctttaattaaaaaaaagctactatgaaggttgaaaaaataattttttggttttttttaattgacacataattgtacatatttatgaggtatagtgtgatattttgaggtgtataatatggaatgatcaaatcagggtaattagcgtatctatcacctcaaacatttatctaaaggtaaataggttttttaaaataatgtaaatagggagtccggcacagtggctcatgcctataatcccagcactttgggaggctgaggcgggtggattgcttgagaccatgaatttgagaccaggctgggcaacatggtgaaaccccagctctcctaaaaatacaaaaattagctggacatggtggtgcatgcctgtagtcccagctacttgggaggaaaaataccaattgtgcacatatttttgtaaaattatacataaacgctttattttttatgtcattctaaataattttttgtatgtttctatttccaaacgttgtttggtaatatatagaaatatgattgattttgtttattgagtttgcatataaccacattactaaactcgcatattgagaattttaataggttattttgaatacttttacatagactgttgtctgaaaatagaaacaggtttatttcttcctttctgatgtggatgtcactgatttttttccctacattactgatctggctaggactatcagtataaagttgaatataagtggtaaaagagctgacttcttgccttggacccagtttttaaatcagttggagagtcaccattaagtgtaatttagtggtagttttgtttgtttttttttttgtttgttttgtagatgccctctatcaggataagttcccttttctcattttgttgagagtttttataaagaatagctattgaattttgtcaaatgcttttgctgcatctgctgaaatgacacgtttattcttcatctacctaataatgttgcaatttatatctgttgagctttgaatgttgaaccagccttgcattcatggtataaatcacttgtttgtaaagtattgtttttaaatattgccagatttgatatcttagtattgtatttttatatttgtcttcatgtgtttttgttttctcataagtgtctgtacccccctttttttttctttaaagagaaataatgagagagattgtctgtcttgaagttctcagtgcctgtgcattgctgccactacacagctagtatcatgacagcagcttcagaaccagagctggcttccaggcaaggctgggtggggaagaaagagaaaaacaaaagaattatttctctatgccgagaccagctcggtcagggagaccctaacctagcggtgctagaggaattaaagacatagacacagaaatatagaggtgtgaagtgggaaatcaggggtctcacagccttcagagctcagccacgaacagagatttacccacgtatttattaacagcaagccagtcattagcattgtttctatagatattaaattaactaaacgtatcccttatgggaaacgaagggaggggccgaattaaaggaataggttgggctagttaactgcagcaggagcatgtccttaaggcacagatcgctcatgctattgtttgtggcttaagaatgcctttaagcggttttccaccccgggcaggccaggtgttccttgccctcattccagtaaacccacaaccttccagcatgggtgttagggccattatgaacatgttacagtgctgcagagattttatttatggccagtttatggccagattttggggggcctgctcccaacactctacatatgctccatcttgcagaggcttcattcttggttctctagctaaaaacagtagaaattttgcacacctgggttagaaaaaaaaatagccattaaacccacccctgttacaggtcactattggtattttgattttgccttcaatccatctgttattgtttacttttaagagtccttgatagttgctttttatgtccagagttttaatttcagtcagaaagagaaataggccttggtgagcatgctttgtcttggctggtgccagaagtctgtactcaaatatttttaaaataatttttagttgaataacaagttagacctgtgtttagctttctcattgttttcctaaaaatagaagaaaaggttttaaatactttaaccacgaaatactttaaagcaggtttaaaataaactccttcattttgcctgttctattactctgttctcacactgctaataaagacatacccaagactggtaatttataaagtaaagaggtttaattgactcacagttccacatggctggggaggcctcccaatcatggcagaaggtgaatgaggagcaaagtcacatctttgtggcaggcaagagagagagcatgtgtgcaggggaattcccctttataaaaccgtccaatctcatgagacttatgcactctcatgggagcagcatgagaaagactcacctccgtgattcagttacctcccactgtgtccctgccacaacatgtgggaattgtgggagctaaaaatcaagatgagatttgggtaggaacacagtcaaaccatatctcctgtatacattcacactagcattttagttttagaactagttctatgttactatctgaattaatttttccacaattttgtaaggaaaaataatgcgttctttgaatttcatgtgtaaatgatatttttagttttgtgtcattttgtccaataaattctgaaaatctttgtattgacagtgtgttatctctgcataaccatatatgtataagagcgctcaataaaaagaataaagag

SEQ ID NO: 32040 - DNA, 4695 bp, Homo sapiens; identical to SEQ ID NO: 32039

SEQ ID NO: 32041 - DNA, 2229 bp, Homo sapiens
cggccaggctggtacaggcggctgctcgcggaggcacttctccgagcgtgacgtgcggactccgctccactgcggcccgcccgcccgccggtctagccgccgcctccttcgctccctgagcacgccaggcgagggtcagctgccggggcgacgcggcgcggagagggcgggcgggggggctgtgggagcgccggtctctatatggcggcggctctgtcgggcctggctgtccggctctcgcgctcggccgccgcccgctcctatggggtcttctgcaaggggctgactcgcacgctgctcatcttcttcgacctggcctggcggctgcgtatcaacttcccctacctctacatcgtggcttccatgatgctcaacgtccgcctgcaggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcggcgagactggctgggaggagggcccagggccactgacggccacagaggacagtgccccaaaggagagcctcgggtgtcacgactgccacgccatcaaaaagtgccggaaatgggaagttttcaggatgacccaccaagtgcttttcccaagggtctgggctctgagttggaacccgcttgcctgcactccatcctgtctgcaacgctgcacgtgtatcccgaagtgctcctgagtgaggagacaaaacgcattttccttgaccgtttaaagcccatgttttcaaagcaaacaatagaattcaagaaaatgcttaaaagcacctcagatggtctgcagataacactggggttactggctctgcaaccttttgaattagcaaatacattatgccatagttaaggtacaagcagaacaataccaatagattaattttaagagttgtcttagaatgatttctttcgcattaagtctggatgcaaactgtgcagcccttaggttcctgctgtagttttgtacgacctggcagacttaaagtaaattgagtttaaattcaaagccagttgatgcggaaggaacttttttggcatgtgttaaattgtgctttaaaagacatataaagaattgggaaacatttcaggagacgatcatagcctgtataaataccagattagaacatacggatttaccatgaagttctgtcttcaacatccattctaaagggctactgtcccaaatcctgtgtgtccttttgacttgtctgatcacccaatggaagtggatacttgtaaagtctacaccactgtacttggcgttaaatcttgctgaattcgtggtaagctgttaccatgtctacattttgtagaatgattttggtctgcagcaaaattcgatttcacttctcatacccctttccttccacttgaaatgcaatttagacagaggccctgtggtgaaagttgcaatattaagtttacctttagaagatcccttctcaaactcagaaccctagcagtgttaccttaaacaaaaatgagctcgagaaaaaagtagctcagttacagagaagcaaatcgagttatttcccacataaaaagtttcccagattctaagaattgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaattactatgccatgtgctattttagtgtttggggaaaatgaaaaataaaatttgttctttagcttaataaatatgtcttattttataaaaaaaaaaaaaaaa

SEQ ID NO: 32042 - DNA, 2603 bp, Homo sapiens
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacttcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaaaaaaaaaaaaaaaaaaaaaaaaaaaaaaaaaaaaaaaaaaaaaaaaaaa

SEQ ID NO: 32043 - DNA, 1743 bp, Homo sapiens
aaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctctttcgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttcctt

SEQ ID NO: 32044 - DNA, 4170 bp, Homo sapiens
ctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagta

SEQ ID NO: 32045 - DNA, 860 bp, Homo sapiens
gccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctccaaaaaaaaaaaaaaaaaaaaaaaaaaaaaaaaaaaaaaaag

SEQ ID NO: 32046 - DNA, 1894 bp, Homo sapiens
aggactcgggccggagcgtggccggacccccacccgccgaggggcccagggaggacgcggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaccaaaaaaaaaaaaaaaaaaaaaaaaaaaaaaaaaaaaaaaaaaaaaaaaaaaaaaaaaa

SEQ ID NO: 32047 - DNA, 5773 bp, Homo sapiens
gtgaccacggaccaggcagtctctaatgaataggcaaggccacaacctccattctcccagaaaagaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgaggagatttgcaccctagttatcgctgagactttccctgaagatgcagggatctttacatgttcagcaagaaatgattatggatcagcaaccagcactgcccagctggttgtcacctcagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgagcggagtccatcccagccgtggagtaaatggactgattaacggcaaagctaacagtaataaatctcttccaacaccagctgtcctgctttcacccactaaggagccaccacctctgcttgccaaaccaaaactaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacatttctcgacattaatagtgaaccacaccaggagaacaaatacccaacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaartccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaartgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtaatattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctagtatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaagtactatcaatcaatcatactactttggattgttgtgctggtgtaatgtggatttaacatcaataaatatttgacaaataaaaaaaaa

SEQ ID NO: 32048 - DNA, 4885 bp, Homo sapiens
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgagtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggt

SEQ ID NO: 32049 - DNA, 5070 bp, Homo sapiens
aggagcaatagcagcagccgtggcgccacggggcgaggcgcggcggtcggtgaccggccggggctgcaggcggcggacggctggaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattytatatgaaaaaggctgaaattgaacatcatgaaatggctaagtcaagtcttcgaatgaggactccatccaaccttgctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaagggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacctacaatgaaccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctgaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccagtttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaagccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctgggaaagaagattcagttgctagaagctaaatttgccgagttagaaggtggagatgatgatattgaagagatgggagaagaagatagtgagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccgggtggaagtccatatggacaacaggtgggagttttggggcctccaaggcagcaggcaccacctccatatcccggcccacatccagctggaccccctgtcatacagcagccaacaacacccatgtttgtagctcccccgccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcataaaa

SEQ ID NO: 32050 - DNA, 4766 bp, Homo sapiens
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcgctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggt

SEQ ID NO: 32051 - DNA, 4825 bp, Homo sapiens
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggt

SEQ ID NO: 32052 - DNA, 3922 bp, Homo sapiens
agatgaagaccagggagaggaaagggtggacctgaggcccccatggagaagggacgggcaggatgtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaac

SEQ ID NO: 32053 - DNA, 4498 bp, Homo sapiens
aaactaaggccttcctggtagccaaggagcccagcagaggggctgctgctggctgctgggattgcagaggccggggtctctgtggtgttgctttcctggaaaggagggacggcacctccagggcagccagcagtgtgggagcccattccagggcgcaaatgggcactcaggaatggaaaatccaagaaggaaccaaccaccaacaaggaaatgcagtgtgagcggcagctgcgaagtctgtgccttcaaatatacagcgcccaggggacctgtgttggacggggagcaaattggcagggctgagagcgccttggttttctgtgcagacaggtccagctgcagaaattaagactggggctgagtcggggagaagccttccatgttgagatggcaactgggcaaagcaggacggagacctgtgtgtctgattagagaggcctgtggcattggcatgtggctggaagtccaggcagggtgccaccaccgcagaggtcaagcatgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccaatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaac

SEQ ID NO: 32054 - DNA, 9965 bp, Homo sapiens
gcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 32055 - DNA, 10034 bp, Homo sapiens
attctagttcaaactccaccagatatttgagctccttctctgtaccaggcattgttctaagatacgtaagtgaacaaaacccatgacaccctcgtctatgagagctgatcctctggcagggacagacaggtcatgagtggagtgatggagcagctggcctggtgacttagccgccttcaggtacagtaggaggagcaagcccagggcagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 32056 - DNA, 10323 bp, Homo sapiens
gcattgttctaagatacgtaagtgaacaaaacccatgacaccctcgtctatgagagctgatcctctggcagggacagacaggtcatgagtggagtgatggagcagctggcctggtgacttagccgccttcaggtacagtaggaggagcaagcccagggcagttctagccaggcacggtggctcacacctgtaatcctaacacttggaaggctgaggtaggaggactgcttgatcctaggaggcagaggttgcaaggagccgaaattgtgccactgtactccagcctgggcaacatagcaagaccctgtcattcatagttctggaggctgggaagttcaagatcaaagtgccagcagattcagtgtcatgtgaggacgtgcttcctgcttcatagataagagtgccacacccccctgtcccagtgcactggggctgtggatcccttcaaagctgagattgcctgtctgtggtctccagcgttaagcacagtcattagctcagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 32057 - DNA, 10049 bp, Homo sapiens
gcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 32058 - DNA, 6111 bp, Homo sapiens
aacaggtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctc

SEQ ID NO: 32059 - DNA, 3204 bp, Homo sapiens
cttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagggactgcccaggactgagtccatatggaagaagaacttcctcttttctctggagacagtggcaagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaaaaaaaaaaaaaaaaaaaaaaaaaaa

SEQ ID NO: 32060 - DNA, 2164 bp, Homo sapiens
gaattcggctttaggaggtccccgggttgccggcggcgacagcgggggaagcatgactgctgtgggccgaaggtgccccgcgctggggtcccgaggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcgctcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgctgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctacgggggactatgggcaacatgttcagcttcgcggcggtcatgggtgccctggacatggctcagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtga

SEQ ID NO: 32061 - DNA, 3114 bp, Homo sapiens
ccacgcgtccggccaagatgacagaggggaccaagaagaccagcaaaaagttcaagttcttcaagttcaagggctttgggagtctctccaacctccctcggtccttcactctgagacgatcctcagcttccatcagtaggcagtcccatttggagcctgacacctttgaagccacgcaggatgacatggtgacggtgcccaagagtcccccagcctatgcccgctccagtgacatgtacagccacatgggcaccatgcctcgccccagcatcaagaaagcacagaactcacaggctgcccggcaggcccaggaggcgggtcccaagcccaacttggtacccggaggtgtacccgaccccccaggcttggaggcagccaaagaggtgatggtgaaggccactggccctctagaggacaccccagcaatggaacccaacccttcagcagtggaggtagaccccatcagaaagcctgaggtccccacaggagacgtagaagaggagagacctcccagggacgtgcactcagaaagggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggctcagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 32062 - DNA, 645 bp, Homo sapiens
atgtcacagaggaaggccagagggccaccagccatgccaggggtggggcatagccagactcaggccaaagcacggttgctgccaggcgctgacaggaagaggagccgcctcagcaggacaaggcaggacccgtgggaagaaagaagctggagcaaccagagatggagcagagctacccctggccctcgagggaccagggctgggggcctggctcttggcaggagcgaggccagtcctgagaatgccgcgcgggagcggagccgggtcaggacgctgcgccaggccttcttggccttgcaggctgctctgcctgccgtgccgcccgacaccaagctctccaagttggacgtgctggtgctcgccgccagctacatagcccacctcacccgcacactcggccacgagttgcctggccctgcctggccgcccttcctgcgtggactccgctacttgcaccctctcaagaagtggccgatgcgatctcgtctctatgctggaggcctggggtactccgatcttgactccaccacagccagcacccccagccaaagaacaagagatgcagaggtggggtcccaagtccctggagaggcagatgctctcctttccaccacaccactctcaccagctcttggtgacaaataa

SEQ ID NO: 32063 - DNA, 2076 bp, Homo sapiens
cggggaaggggagggaggagggggacgagggctctggcgggtttggaggggctgaacatcgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggcttatgcaagcaaagatctggaggagcagttacggtctgtgtccagtgtagatgaactcatgactgtactctacccagaatattggaaaatgtacaagtgtcagctaaggaaaggaggctggcaacataacagagaacaggccaacctcaactcaaggacagaagagactataaaatttgctgcagcacattataatacagagatcttgaaaagtattgataatgagtggagaaagactcaatgcatgccacgggaggtgtgtatagatgtggggaaggagtttggagtcgcgacaaacaccttctttaaacctccatgtgtgtccgtctacagatgtgggggttgctgcaatagtgaggggctgcagtgcatgaacaccagcacgagctacctcagcaagacgttatttgaaattacagtgcctctctctcaaggccccaaaccagtaacaatcagttttgccaatcacacttcctgccgatgcatgtctaaactggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcctcttgtgatttctttaaaagaatgactatataatttatttccactaaaaatattgtttctgcattcatttttatagcaacaacaattggtaaaactcactgtgatcaatatttttatatcatgcaaaatatgtttaaaataaaatgaaaattgtattat

SEQ ID NO: 32064 - DNA, 8129 bp, Homo sapiens
atggtcttcgagttcttggaaaatgttcgcaaagcaactgtctgttgtggtcagggggccgcgttgctgctggcggctgctccctgggatagtggcgttttgtgtcctttttcccctagtgggggagcccctcctgaggaatgccctgtcagcggagatgtgcgcaggaccgggctgtcacccccctgcacccgcggacatccatcccgggctgacatcggtgccccccccgcccccggaaggtggtcagagaggacgcagacggggataactgctggcacacagctggctggcacagaggccgcttctctgggcgcagaccccaggagctgctgctctgaaagaaggcaggagctgatagccctagagcacagggttttggtgattggtaaggtgcacctcctgggagcaggcacgtcttttggctcttctgaccatggagagataggacggtccctgcagcccgcgcgacagaaagctgtgccgccaccaccggccgcgcccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctcggcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttcttcctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgcccccccgtcctacactccatcaaacaggagccggtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatatttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcctgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccagaacgttttgttcactgagcaaaaaaacagatgaaacaaccacaggccaggacttcaagtgaggaggacgcctttgtttgccgtggttggtgggagcacacgccggagcccggtaacgtgcctgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctgagatttgtaagacatttttccccaatttcagagggtggcgtaaatcgtttgacagcccgctttggtctgtggttatttatttttgttggctgaacataaaccaaagtgttaatgctctttatttatggaagagttttagggtaattcacaagatcgttcatctgaacagatgcccagatggcccgagtggtttttttccaactcttttgtggactcgaggacatacagttttttaatggagacgctgtgtttttctcattttctttcacagcacacatgttatttccccactgaatacacccactgttcttacccttgcactgtcacccatacaggacgcacagggatggacgcggacggaattctgactcagccacacctggaggaaattattgtgtcaaaaatgtggggacacaagggctggcactgtggtttgcaatggtttactgatgagacagcaaaaatgagacaggaccatcagatgcaataaagattctaattta

SEQ ID NO: 32065 - DNA, 8122 bp, Homo sapiens
atggtcttcgagttcttggaaaatgttcgcaaagcaactgtctgttgtggtcagggggccgcgttgctgctggcggctgctccctgggatagtggcgttttgtgtcctttttcccctagtgggggagcccctcctgaggaatgccctgtcagcggagatgtgcgcaggaccgggctgtcacccccctgcacccgcggacatccatcccgggctgacatcggtgccccccccgcccccggaaggtggtcagagaggacgcagacggggataactgctggcacacagctggctggcacagaggccgcttctctgggcgcagaccccaggagctgctgctctgaaagaaggcaggagctgatagccctagagcacagggttttggtgattggtaaggtgcacctcctgggagcaggcacgtcttttggctcttctgaccatggagagataggacggtccctgcagcccgcgcgacagaaagctgtgccgccaccaccggccgcgcccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctcggcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttcttcctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccggtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatatttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcccgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccagaacgttttgttcactgagcaaaaaaacagatgaaacaaccacaggccaggacttcaagtgaggaggacgcctttgtttgccgtggttggtgggagcacacgccggagcccggtaacgtgcctgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctgagatttgtaagacatttttccccaatttcagagggtggcgtaaatcgtttgacagcccgctttggtctgtggttatttatttttgttggctgaacataaaccaaagtgttaatgctctttatttatggaagagttttagggtaattcacaagatcgttcatctgaacagatgcccagatggcccgagtggtttttttccaactcttttgtggactcgaggacatacagttttttaatggagacgctgtgtttttctcattttttttcacagcacacatgttatttccccactgaatacacccactgttcttacccttgcactgtcacccatacaggacgcacagggatggacgcggacggaattctgactcagccacacctggaggaaattattgtgtcaaaaatgtggggacacaagggctggcactgtggtttgcaatggtttactgatgagacagcaaaaatgagacaggaccatcagatgcaataaagattctaattta

SEQ ID NO: 32066 - protein, 1207 aa, Homo sapiens
MRLTHICCCCLLYQLGFLSNGIVSELQFAPDREEWEVVFPALWRREPVDPAGGSGGSADPGWVRGVGGGGSARAQAAGSSREVRSVAPVPLEEPVEGRSESRLRPPPPSEGEEDEELESQELPRGSSGAAALSPGAPASWQPPPPPQPPPSPPPAQHAEPDGDEVLLRIPAFSRDLYLLLRRDGRFLAPRFAVEQRPNPGPGPTGAASAPQPPAPPDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVFNLFQHKSLGVQVNLRVIKLILLHETPPELYIGHHGEKMLESFCKWQHEEFGKKNDIHLEMSTNWGEDMTSVDAAILITRKDFCVHKDEPCDTVGIAYLSGMCSEKRKCIIAEDNGLNLAFTIAHEMGHNMGINHDNDHPSCADGLHIMSGEWIKGQNLGDVSWSRCSKEDLERFLRSKASNCLLQTNPQSVNSVMVPSKLPGMTYTADEQCQILFGPLASFCQEMQHVICTGLWCKVEGEKECRTKLDPPMDGTDCDLGKWCKAGECTSRTSAPEHLAGEWSLWSPCSRTCSAGISSRERKCPGLDSEARDCNGPRKQYRICENPPCPAGLPGFRDWQCQAYSVRTSSPKHILQWQAVLDEEKPCALFCSPVGKEQPILLSEKVMDGTSCGYQGLDICANGRCQKVGCDGLLGSLAREDHCGVCNGNGKSCKIIKGDFNHTRGAGYVEVLVIPAGARRIKVVEEKPAHSYLALRDAGKQSINSDWKIEHSGAFNLAGTTVHYVRRGLWEKISAKGPTTAPLHLLVLLFQDQNYGLHYEYTIPSDPLPENQSSKAPEPLFMWTHTSWEDCDATCGGGERKTTVSCTKIMSKNISIVDNEKCKYLTKPEPQIRKCNEQPCQTRWMMTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 32067 - protein, 1691 aa, Homo sapiens
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPVHLFIESKTLQGSKGEHSFNSPGVFVVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCLGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDRDCTDTTHYCMFVKHLNLCSLDRYKQRCCQSCQEG

SEQ ID NO: 32068 - protein, 977 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSELEPPAPESPMALLADPAPAADPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 32069 - protein, 955 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 32070 - protein, 204 aa, Homo sapiens
MALSDADVQKQAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGVEIYNGDRKIKVSNTLESRLDLIAQQMMPEVRGALFGANANRKFLD

SEQ ID NO: 32071 - protein, 196 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITGLYQLLEPRMIVRCRKQDFPLVKAAVQKAIPMYKIATKNDVDVQIDQESYLPEDIAGGVEIYNGDRKIKVSNTLESRLDLIAQQMMPEVRGALFGANANRKFLD

SEQ ID NO: 32072 - protein, 226 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGVEIYNGDRKIKVSNTLESRLDLIAQQMMPEVRGALFGANANRKFLD

SEQ ID NO: 32073 - protein, 518 aa, Homo sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 32074 - protein, 468 aa, Homo sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 32075 - protein, 396 aa, Homo sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQKLQVLQCLKFPGLSQQRM

SEQ ID NO: 32076 - protein, 569 aa, Homo sapiens
MDPAEAVLQEKALKFMNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 32077 - protein, 605 aa, Homo sapiens
MDPAEAVLQEKALKFMCSMPRSLWLGCSSLADSMPSLRCLYNPGTGALTAFQNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 32078 - protein, 370 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 32079 - protein, 170 aa, Homo sapiens
MKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 32080 - protein, 451 aa, Homo sapiens
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKDEETEAQRGEVPGPRPHSQNLPLDSDQESQEARLPERGTALPTARWPPRRSLERLPSPDPGAEGHGQSRQSDQDITKT

SEQ ID NO: 32081 - protein, 401 aa, Homo sapiens
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 32082 - protein, 1220 aa, Homo sapiens [sequence omitted]

SEQ ID NO: 32083 - protein, 462 aa, Homo sapiens
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 32084 - protein, 479 aa, Homo sapiens
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 32085 - protein, 595 aa, Homo sapiens [sequence omitted]

SEQ ID NO: 32086 - protein, 621 aa, Homo sapiens
MSPVFPMLTVLTMFYYICLRRRARTATRGEMMNTHRAIESNSQTSPLNAEVVQYAKEVVDFSSHYGSENSMSYTMWNLAGVPNVFPSSGDFTQTAVFRTYGTWWDQCPSASLPFKRTPPNFQSQDYVELTFEQQVYPTAVHVLETYHPGAVIRILACSANPYSPNPPAEVRWEILWSERPTKVNASQARQFKPCIKQINFPTNLIRLEVNSSLLEYYTELDAVVLHGVKDKPVLSLKTSLIDMNDIEDDAYAEKDGCGMDSLNKKFSSAVLGEGPNNGYFDKLPYELIQLILNHLTLPDLCRLAQTCKLLSQHCCDPLQYIHLNLQPYWAKLDDTSLEFLQSRCTLVQWLNLSWTGNRGFISVAGFSRFLKVCGSELVRLELSCSHFLNETCLEVISEMCPNLQALNLSSCDKLPPQAFNHIAKLCSLKRLVLYRTKVEQTALLSILNFCSELQHLSLGSCVMIEDYDVIASMIGAKCKKLRTLDLWRCKNITENGIAELASGCPLLEELDLGWCPTLQSSTGCFTRLAHQLPNLQKLFLTANRSVCDTDIDELACNCTRLQQLDILGTRMVSPASLRKLLESCKDLSLLDVSFCSQIDNRAVLELNASFPKVFIKKSFTQ

SEQ ID NO: 32087 - protein, 225 aa, Homo sapiens
MAQGFHRSSVPESTLSRPELWIYQGLKPPRKMKGLYQAAGRILVTLGILSVCSGVIAFFPVFSYKPWFTGWSVRIACPIWNGALAITTGVLLLLAYREWTQRYLGEATFTFVILSIMGCPLHFAIALESALLGPYCFYSFSGIAGTNYLGYAVTFPYPYAKFPLACVDPPHYEEYHLTLQALDLCLSFTLLCTSLTVFIKLSARLIQNGHINMQLPAGNPNPFSP

SEQ ID NO: 32088 - protein, 225 aa, Homo sapiens; identical to SEQ ID NO: 32087

SEQ ID NO: 32089 - protein, 1395 aa, Homo sapiens
MTGAEIESGAQVKPEKKPGEEVVGGAEIENDVPLVVRPKVRTQAQIMPGARPKNKSKVMPGASTKVETSAVGGARPKSKAKAIPVSRFKEEAQMWAQPRFGAERLSKTERNSQTNIIASPLVSTDSVLVAKTKYLSEDRELVNTDTESFPRRKAHYQAGFQPSFRSKEETNMGSWCCPRPTSKQEASPNSDFKWVDKSVSSLFWSGDEVTAKFHPGNRVKDSNRSMHMANQEANTMSRSQTNQELYIASSSGSEDESVKTPWFWARDKTNTWSGPREDPNSRSRFRSKKEVYVESSSGSEHEDHLESWFGAGKEGKFRSKMRAGKEANNRARHRAKREACIDFMPGSIDVIKKESCFWPEENANTFSRPMIKKEARARAMTKEEAKTKARARAKQEARSEEEALIGTWFWATDESSMADEASIESSLQVEDESIIGSWFWTEEEASMGTGASSKSRPRTDGERIGDSLFGAREKTSMKTGAEATSESILAADDEQVIIGSWFWAGEEVNQEAEEETIFGSWFWVIDAASVESGVGVSCESRTRSEEEEVIGPWFWSGEQVDIEAGIGEEARPGAEEETIFGSWFWAENQTYMDCRAETSCDTMQGAEEEEPIIGSWFWTRVEACVEGDVNSKSSLEDKEEAMIPCFGAKEEVSMKHGTGVRCRFMAGAEETNNKSCFWAEKEPCMYPAGGGSWKSRPEEEEDIVNSWFWSRKYTKPEAIIGSWLWATEESNIDGTGEKAKLLTEEETIINSWFWKEDEAISEATDREESRPEAEEGDIIGSWFWAGEEDRLEPAAETREEDRLAAEKEGIVGSWFGAREETIRREAGSCSKSSPKAEEEEVIIGSWFWEEEASPEAVAGVGFESKPGTEEEEITVGSWFWPEEEASIQAGSQAVEEMESETEEETIFGSWFWDGKEVSEEAGPCCVSKPEDDEEMIVESWFWSRDKAIKETGTVATCESKPENEEGAIVGSWFEAEDEVDNRTDNGSNCGSRTLADEDEAIVGSWFWAGDEAHFESNPSPVFRAICRSTCSVEQEPDPSRRPQSWEEVTVQFKPGPWGRVGFPSISPFRFPKEAASLFCEMFGGKPRNMVLSPEGEDQESLLQPDQPSPEFPFQYDPSYRSVQEIREHLRAKESTEPESSSCNCIQCELKIGSEEFEELLLLMEKIRDPFIHEISKIAMGMRSASQFTRDFIRDSGVVSLIETLLNYPSSRVRTSFLENMIRMAPPYPNLNIIQTYICKVCEETLAYSVDSPEQLSGIRMIRHLTTTTDYHTLVANYMSGFLSLLATGNAKTRFHVLKMLLNLSENLFMTKELLSAEAVSEFIGLFNREETNDNIQIVLAIFENIGNNIKKETVFSDDDFNIEPLISAFHKVEKFAKELQGKTDNQNDPEGDQEN

SEQ ID NO: 32090 - protein, 126 aa, Homo sapiens
MADEIAKAQVARPGGDTIFGKIIRKEIPAKIIFEDDRCLAFHDISPQAPTHFLVIPKKHISQISVAEDDDESLLGHLMIVGKKCAADLGLNKGYRMVVNEGSDGGQSVYHVHLHVLGGRQMHWPPG

SEQ ID NO: 32091 - protein, 313 aa, Homo sapiens
MDFDERGPCSSNMYLPSCTYYVSGPDFSSLPSFLPQTPSSRPMTYSYSSNLPQVQPVREVTFREYAIEPATKWHPRGNLAHCYSAEELVHRDCLQAPSAAGVPGDVLAKSSANVYHHPTPAVSSNFYSTVGRNGVLPQAFDQFFETAYGTPENLASSDYPGDKSAEKGPPAATATSAAAAAAATGAPATSSSDSGGGGGCRETAAAAEEKERRRRPESSSSPESSSGHTEDKAGGSSGQRTRKKRCPYTKYQIRELEREFFFSVYINKEKRLQLSRMLNLTDRQVKIWFQNRRMKEKKINRDRLQYYSANPLL

SEQ ID NO: 32092 - protein, 1188 aa, Homo sapiens
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 32093 - protein, 1188 aa, Homo sapiens; identical to SEQ ID NO: 32092

SEQ ID NO: 32094 - protein, 1428 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFGKDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 32095 - protein, 1426 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 32096 - protein, 366 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 32097 - protein, 279 aa, Homo sapiens
MSALEWYAHKSLGDGIFWIQERFYESGNRANIWLVRGSEQDVVIDTGLGLRSLPEYLYSSGLLQDREAKEDAARRPLLAVATHVHFDHSGGLYQFDRVAVHHAEAEALARGDNFETVTWLSDSEVVRAPSPGWRARQFRVQAVQPTLILQDGDVINLGDRQLTVMHMPGHSRGSICLHDKDRKILFSGDVVYDGSLIDWLPYSRISDYVGTCERLIELVDRGLVEKVLPGHFNTFGAERLFRLASNYISKAGICHKVSTFAMRSLASLALRVTNSRTSP

SEQ ID NO: 32098 - protein, 183 aa, Homo sapiens
MAHGGPRGQLLGADGQEVQPEALMQELSRCQVLQGRPKIFLLQACRGGNRDAGVGPTALPWYWSWLRAPPSVPSHADVLQIYAEAQGSSCRGTPPGSSDQADILTVYSAAEGYVAYRDDKGSDFIQTLVEVLRANPGRDLLELLTEVNRRVCEQEVLGPDCDELRKACLEIRSSLRRRLCLQA

SEQ ID NO: 32099 - protein, 183 aa, Homo sapiens; identical to SEQ ID NO: 32098

SEQ ID NO: 32100 - protein, 42 aa, Homo sapiens
MVALMKVYQEEDEAYQELVTVATTFFQYLLRPFRAMREVATL

SEQ ID NO: 32101 - protein, 131 aa, Homo sapiens
MQKEMEQDVKRFGQAAWATAIPRLEKLKLMLAQETLQLMRAKELCLNHKRAEIQGKMEDLPEQEKNINVVDELAIQFYEIQLELYEVKFEILKNKEILLTTQLDSLERLIKEKQDEVVYYDPCESPEELSH

SEQ ID NO: 32102 - protein, 131 aa, Homo sapiens; identical to SEQ ID NO: 32101

SEQ ID NO: 32103 - protein, 42 aa, Homo sapiens
MVALMKVYQEEDEAYQELVTVATTFFQYLLQPFRAMREVATL

SEQ ID NO: 32104 - protein, 259 aa, Homo sapiens
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPAPTECFARVSCSGVEALGRRDWLGGGPRATDGHRGQCPKGEPRVSRLPRHQKVPEMGSFQDDPPSAFPKGLGSELEPACLHSILSATLHVYPEVLLSEETKRIFLDRLKPMFSKQTIEFKKMLKSTSDGLQITLGLLALQPFELANTLCHS

SEQ ID NO: 32105 - protein, 287 aa, Homo sapiens
MAAPRQIPSHIVRLKPSCSTDSSFTRTPVPTVSLASRELPVSSWQVTEPSSKNLWEQICKEYEAEQPPFPEGYKVKQEPVITVAPVEEMLFHGFSAEHYFPVSHFTMISRTPCPQDKSETINPKTCSPKEYLETFIFPVLLPGMASLLHQAKKEKCFERKRTKFIACDFLTEWLYNQNPKRAGEPFTEFFSIPFVEERLKQHPRPPIPLSLLLTEEEAALYIQSFWRACVVRCDPEIQELRQWQKKLREAKHIHQQVKIFWAKQEQKVKCKMEDDAVPAAKMKIPSS

SEQ ID NO: 32106 - protein, 476 aa, Homo sapiens
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 32107 - protein, 1156 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 32108 - protein, 97 aa, Homo sapiens
MNQENPPPYPGPGPTAPYPPYPPQPMGPGPMGGPYPPPQGYPYQGYPQYGWQGGPQEPPKTTVYVVEDQRRDELGPSTCLTACWTALCCCCLWDMLT

SEQ ID NO: 32109 - protein, 424 aa, Homo sapiens [sequence omitted]

SEQ ID NO: 32110 - protein, 1106 aa, Homo sapiens
MSGTSSHESFYDSLSDMQEESKNTDFFPGLSAFLSQEEINKSLDLARRAIADSETEDFDSEKEISQIFSTSPASLCEHPSHKETKLGEHASRRPQDNRSTPVQPLAEKQTKSISSPVSKRKPAMSPLLTRPSYIRSLRKAEKRGAKTPSTNVKPKTPHQRKGGPQSQLCDKAANLIEELTSIFKAAKPRNRSPNGESSSPDSGYLSPKNQPSALLSASASQSPMEDQGEMEREVKSPGARHCYQDNQDLAVPHNRKSHPQPHSALHFPAAPRFIQKLRSQEVAEGSRVYLECRVTGNPTPRVRWFCEGKELHNTPDIQIHCEGGDLHTLIIAEAFEDDTGRYTCLATNPSGSDTTSAEVFIEGASSTDSDSESLAFKSRAGAMPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPEEICTLVIAETFPEDAGIFTCSARNDYGSATSTAQLVVTSANTENCSYESMGESNNDHFQHFPPPPPILETSSLELASKKPSEIQQVNNPELGLSRAALQMQFNAAERETSGVHPSRGVNGLINGKANSNKSLPTPAVLLSPTKEPPPLLAKPKLGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYISRH

SEQ ID NO: 32111 - protein, 1602 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMSNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 32112 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKRDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPVCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCKPTEIPENDILLCESRYNESDKQMKKFKGLKRFSLSAKVVDDEIYYFRKPIVPQKEPSPLLGKKIQLLEAKFAELEGGDDDIEEMGEEDSESTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPRQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 32113 - protein, 856 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNR

SEQ ID NO: 32114 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 32115 - protein, 1006 aa, Homo sapiens
MHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 32116 - protein, 729 aa, Homo sapiens
MNSVLTKHGSPPRSWLSLCSGTDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVANRLRGALHPPRERVHAAAAGAAAAGGRGEPHRRLRGGGKQQRRSGQAPEGISAPGLDSAHPWRLPGGDAAAAAGGEPEDEGGEGQQDGCVLLPLHGSAVGDQSSEEGREDQGHQATPARGQDCVPGATGPWVLPPYLPE

SEQ ID NO: 32117 - protein, 468 aa, Homo sapiens
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPPFVIHDMETLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAAIICCGDRPGLLNVGHIEKMQEGIVHVLRLHLQSNHPDDIFLFPKLLQKMADLRQLVTEHAQLVQIIKKTESDAALHPLLQEIYRDMY

SEQ ID NO: 32118 - protein, 468 aa, Homo sapiens; identical to SEQ ID NO: 32117

SEQ ID NO: 32119 - protein, 468 aa, Homo sapiens; identical to SEQ ID NO: 32117

SEQ ID NO: 32120 - protein, 468 aa, Homo sapiens; identical to SEQ ID NO: 32117

SEQ ID NO: 32121 - protein, 1064 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 32122 - protein, 551 aa, Homo sapiens
MEEELPLFSGDSGKPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 32123 - protein, 703 aa, Homo sapiens
MTAVGRRCPALGSRGAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARCSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 32124 - protein, 860 aa, Homo sapiens
MTEGTKKTSKKFKFFKFKGFGSLSNLPRSFTLRRSSASISRQSHLEPDTFEATQDDMVTVPKSPPAYARSSDMYSHMGTMPRPSIKKAQNSQAARQAQEAGPKPNLVPGGVPDPPGLEAAKEVMVKATGPLEDTPAMEPNPSAVEVDPIRKPEVPTGDVEEERPPRDVHSERAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 32125 - protein, 214 aa, Homo sapiens
MSQRKARGPPAMPGVGHSQTQAKARLLPGADRKRSRLSRTRQDPWEERSWSNQRWSRATPGPRGTRAGGLALGRSEASPENAARERSRVRTLRQAFLALQAALPAVPPDTKLSKLDVLVLAASYIAHLTRTLGHELPGPAWPPFLRGLRYLHPLKKWPMRSRLYAGGLGYSDLDSTTASTPSQRTRDAEVGSQVPGEADALLSTTPLSPALGDK

SEQ ID NO: 32126 - protein, 419 aa, Homo sapiens
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS
